US008143228B2

(12) United States Patent
Mabjeesh

(10) Patent No.: US 8,143,228 B2
(45) Date of Patent: Mar. 27, 2012

(54) AGENTS CAPABLE OF DOWNREGULATING AN MSF-A DEPENDENT HIF-1α AND USE THEREOF IN CANCER TREATMENT

(75) Inventor: Nicola J. Mabjeesh, Tel-Aviv (IL)

(73) Assignee: Medical Research Fund of Tel Aviv Sourasky Medical Center, Tel-Aviv (IL)

( * ) Notice: Subject to any disclaimer, the term of this patent is extended or adjusted under 35 U.S.C. 154(b) by 963 days.

(21) Appl. No.: 11/632,231

(22) PCT Filed: Jul. 12, 2005

(86) PCT No.: PCT/IL2005/000736
§ 371 (c)(1),
(2), (4) Date: Jan. 11, 2007

(87) PCT Pub. No.: WO2006/038208
PCT Pub. Date: Apr. 13, 2006

(65) Prior Publication Data
US 2009/0098127 A1    Apr. 16, 2009

Related U.S. Application Data

(60) Provisional application No. 60/586,697, filed on Jul. 12, 2004.

(51) Int. Cl.
*C12N 15/11* (2006.01)
(52) U.S. Cl. ..................................... 514/44 A
(58) Field of Classification Search ................ 514/44 A
See application file for complete search history.

(56) References Cited

U.S. PATENT DOCUMENTS 5,849,556 A * 12/1998 Hillman et al. ............... 435/195
2004/0259247 A1 * 12/2004 Tuschl et al. .................. 435/375

FOREIGN PATENT DOCUMENTS
WO    WO 2004/074441    9/2004

OTHER PUBLICATIONS

Lee et al., Biochemical and Biophysical Research Communications, vol. 300: 241-246, 2003.*
Montagna et al. Cancer Research 63: 2179-2187, 2003.*
International Search Report Dated Feb. 2, 2007 From the International Searching Authority Re.: Application No. PCT/IL05/00736.
Supplementary European Search Report and the European Search Opinion Dated Oct. 1, 2007 From the European Patent Office Re.: Application No. 05759367.5.
Written Opinion Dated Feb. 2, 2007 From the International Searching Authority Re.: Application No. PCT/IL05/00736.
Amir et al. "MSF-A Interacts With Hypoxia-Inducible Factor-1α and Augments Hypoxia-Inducible Factor Transcriptional Activation to Affect Tumorigenicity and Angiogenesis", Cancer Research, 66(2): 856-866, 2006. p. 856-866.
Kalikin et al. "Genomic and Expression Analyses of Alternatively Spliced Transcripts of the MLL Septin-Like Fusion Gene (MSF) That Map to A 17q25 Region of Loss in Breast and Ovarian Tumors", Genomics, 63: 165-172, 2000.
Nagata et al. "Filament Formation of MSF-A, A Mammalian Septin, in Human Mammary Epithelial Cells Depends on Interactions With Microtubules", The Journal of Biological Chemistry, 278(20): 18538-18543, 2003.
Nagata et al. "Filament Formation of MSF-A, A Mammalian Septin, in Mammary HMEC Cells Depends on Interactions With Microtubules", Molecular Biology of the Cell, 13(Suppl.): 189a/No. 1061, 2002. & 42nd Annual Meetin of the American Society for Cell Biology, San Francisco, CA, USA, 2002. Abstract.
Russell et al. "Isolation and Mapping of a Human Septin Gene to a Region on Chromosome 17q, Commonly Deleted in Sporadic Epithelial Ovarian Tumors", Cancer Research, 60(17): 4729-4734, 2000. p. 4729, r-h Col., Lines 27-34, p. 4731, r-h Col., § 3, p. 4734, 1-h Col., § 2, Fig.3.
Surka et al. "The Mammalian Septin MSF Localizes With Microtubules and Is Required for Completion of Cytokinesis", Molecular Biology of the Cell, 13: 3532-3545, 2002. p. 3533, r-h Col., § 3, p. 3534, r-h Col., § 4—p. 3535, 1-h Col., § 1, p. 3538, r-h Col., § 2—p. 3541, r-h Col., Line 2, p. 3543, r-h Col., § 2.
Communication Pursuant to Article 94(3) EPC Dated Aug. 21, 2009 From the European Patent Office Re.: Application No. 05759367.5.
Response Dated Dec. 15, 2009 to Communication Pursuant to Article 94(3) EPC of Aug. 21, 2009 From the European Patent Office Re.: Application No. 05759367.5.
Office Action Dated Feb. 7, 2010 From the Israel Patent Office Re.: Application No. 180584 and Its Translation Into English.
Response Dated Jun. 7, 2010 to Office Action of Feb. 7, 2010 From the Israel Patent Office Re.: Application No. 180584.
Office Action Dated Jun. 20, 2011 From the Israel Patent Office Re.: Application No. 180584 and Its Translation Into English.
Communication Pursuant to Article 94(3) EPC Dated Feb. 13, 2008 From the European Patent Office Re.: Application No. 05759367.5.
International Preliminary Report on Patentability Dated Apr. 12, 2007 From the International Bureau of WIPO Re.: Application No. PCT/IL2005/000736.
Invitation to Pay Additional Fees Dated Jun. 27, 2006 From the International Searching Authority Re.: Application No. PCT/IL05/00736.
Amir et al. "MSF-A Interacts With Hypoxia-Inducible Factor-1α and Augments Hypoxia-Inducible Factor Transcriptional Activation to Affect Tumorigenicity and Angiogenesis", Cancer Research, 66(2): 856-866, 2006. p. 856-866.
Lee et al. "Inhibition of Hypoxia-Induced Angiogenesis by FK228, A Specific Histone Deacetylase Inhibitor, Via Suppression of HIF-1? Activity", Biochemical and Biophysical Research Communications, 300: 241-246, 2003.
Schindl et al. "Overexpression of Hypoxia-Inducible Factor 1Alpha Is Associated With an Unfavorable Prognosis in Lymph Node-Positive Breast Cancer", Clinical Cancer Research, 8: 1831-1837, 2002.
Response Dated Mar. 27, 2011 to Communication Pursuant to Article 94(3) EPC of Nov. 30, 2010 From the European Patent Office Re.: Application No. 05759367.5.
Communication Pursuant to Article 94(3) EPC Dated Nov. 30, 2010 From the European Patent Office Re.: Application No. 05759367.5.
Nagata et al. "The High Level of hCDC10 Gene Expression in Neuroblastoma May Be Associated With Favorable Characteristics of the Tumor", The Journal of Surgical Research, 92(2): 267-275, Aug. 2000. Abstract.
Response Dated Oct. 23, 2011 to Office Action of Jun. 20, 2011 From the Israel Patent Office Re.: Application No. 180584, pp 1-8.

* cited by examiner

Primary Examiner — Brian Whiteman

(57) ABSTRACT

Methods and pharmaceutical compositions for the treatment of cancer or acute ischemia are provided. Also provided are methods of identifying agents capable of preventing the formation of or dissociating the MSF-A-HIF-1alpha protein complex, and methods of determining the prognosis of an individual having cancer by identifying the presence or absence of such a protein complex.

3 Claims, 45 Drawing Sheets
(16 of 45 Drawing Sheet(s) Filed in Color)

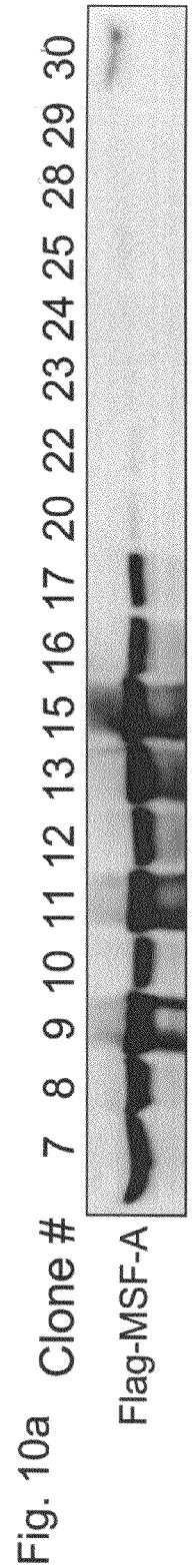
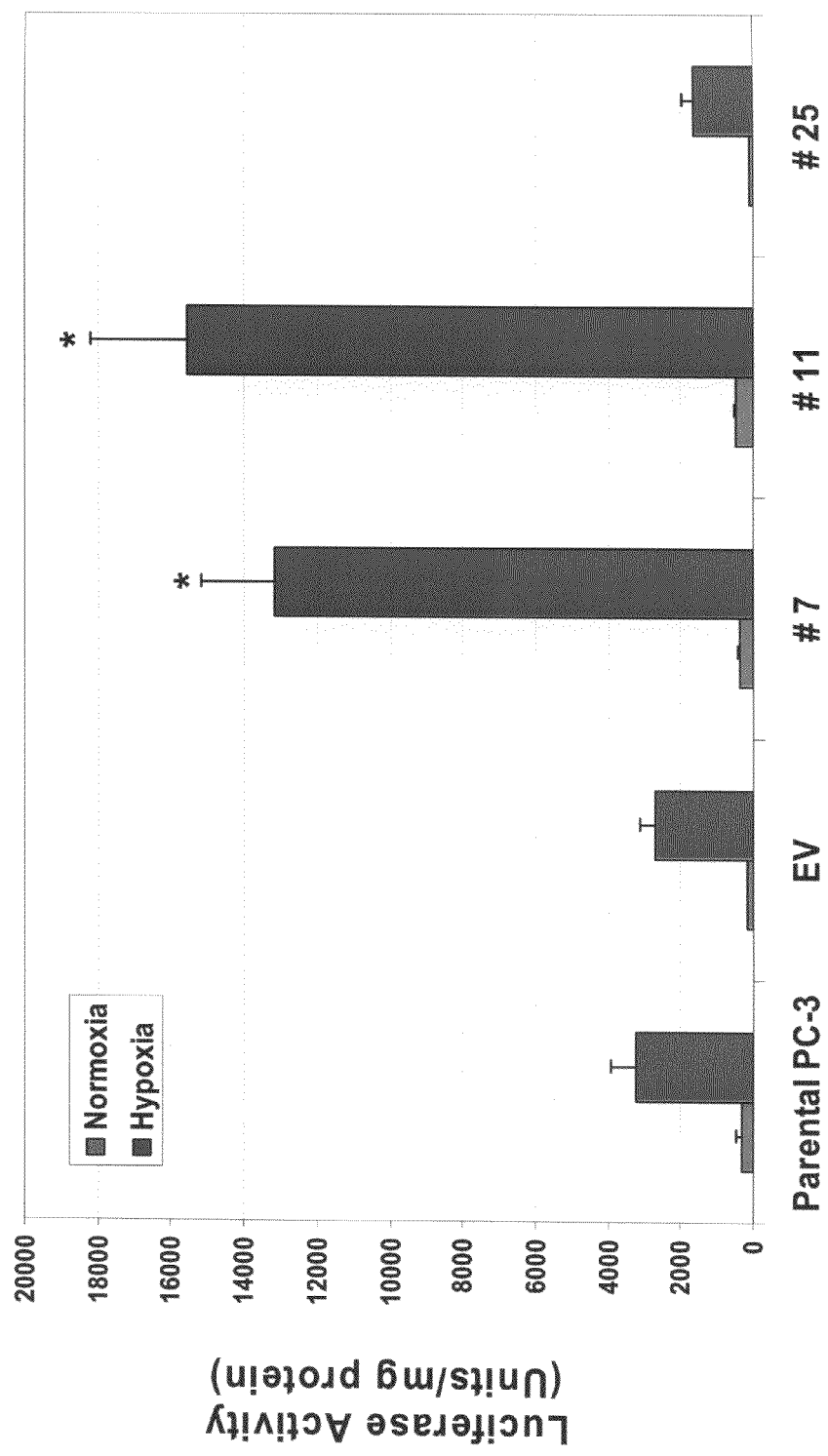
Fig. 10a
Fig. 10b

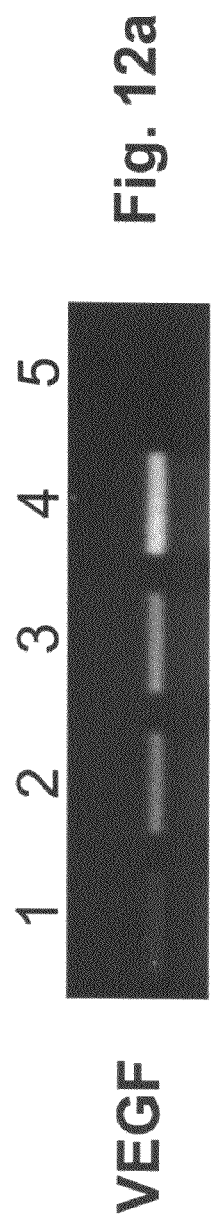
Fig. 12a VEGF
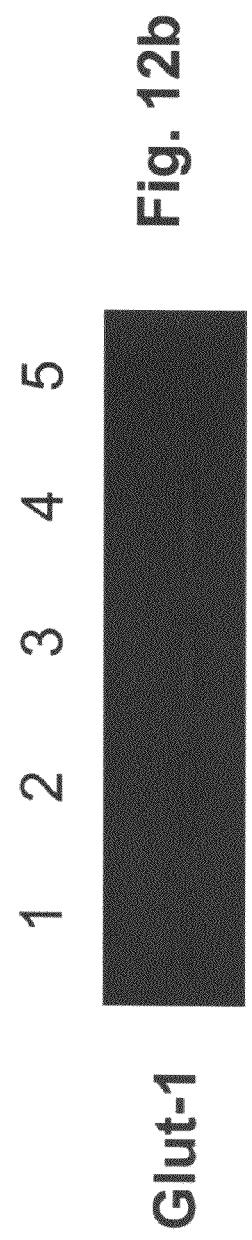
Fig. 12b Glut-1
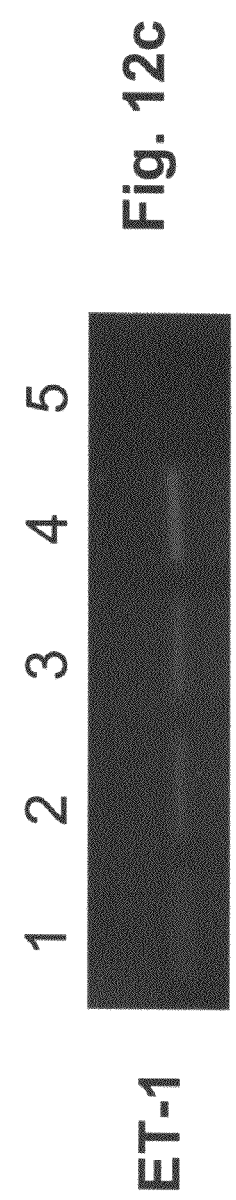
Fig. 12c ET-1

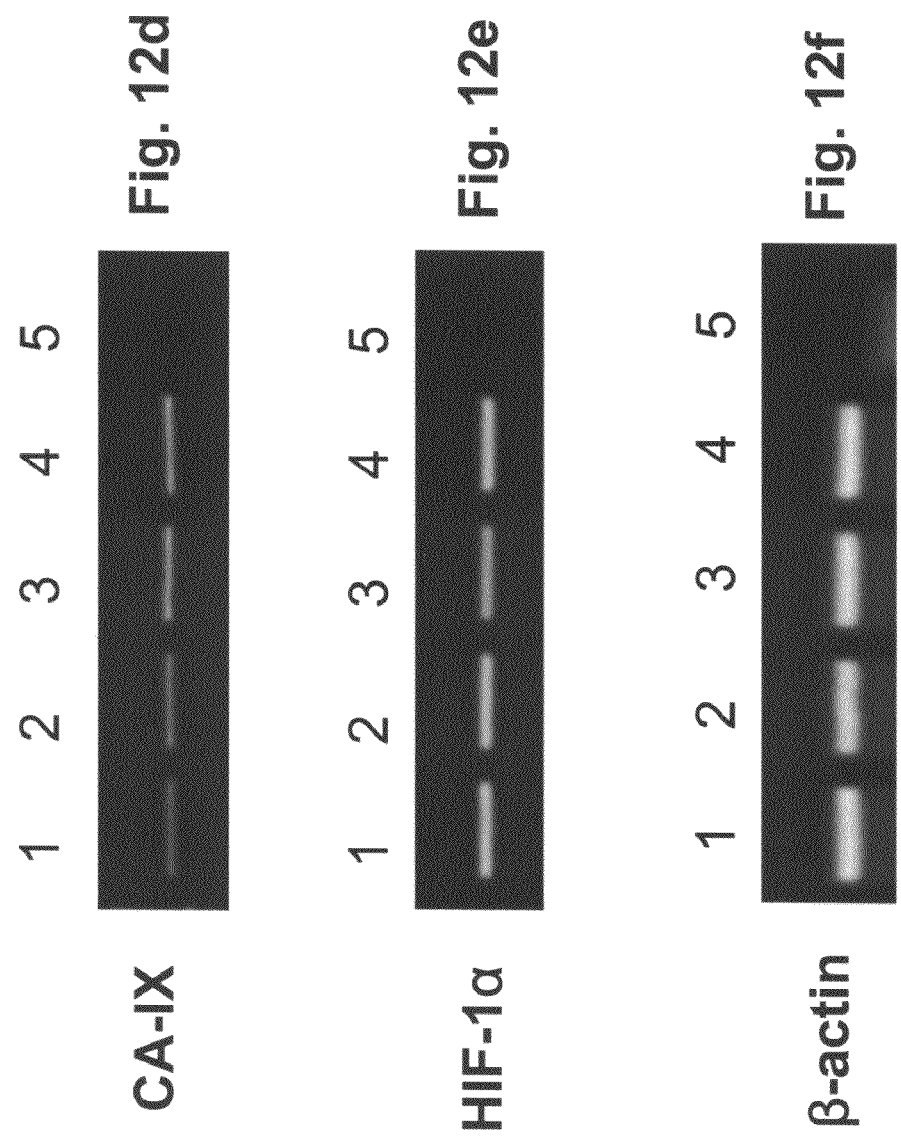

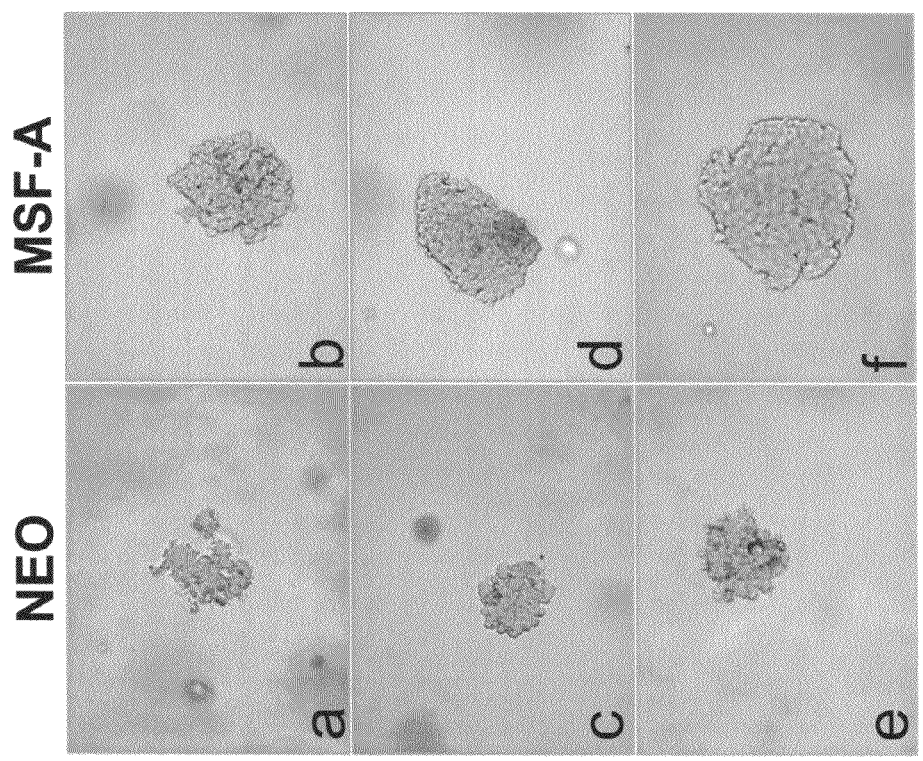
Figs. 14a-f

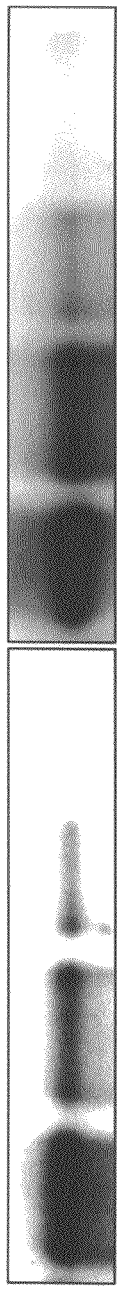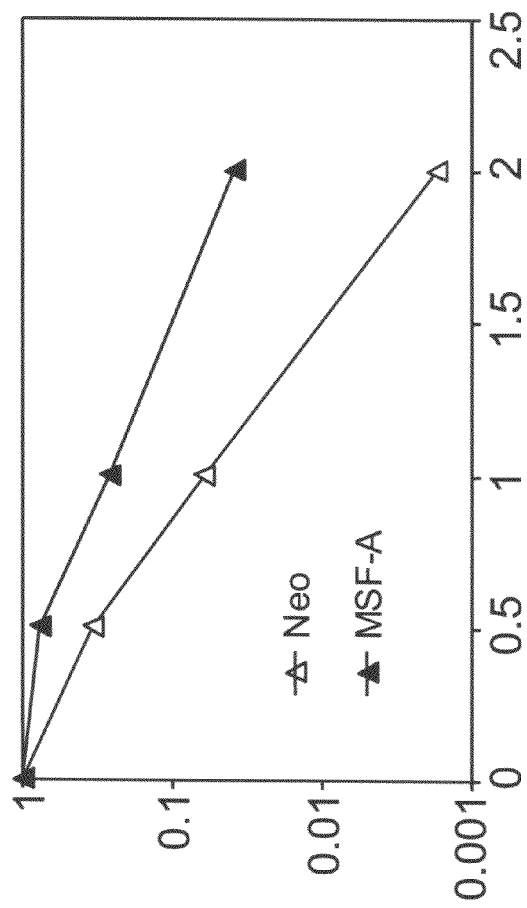
Fig. 17a
Fig. 17b

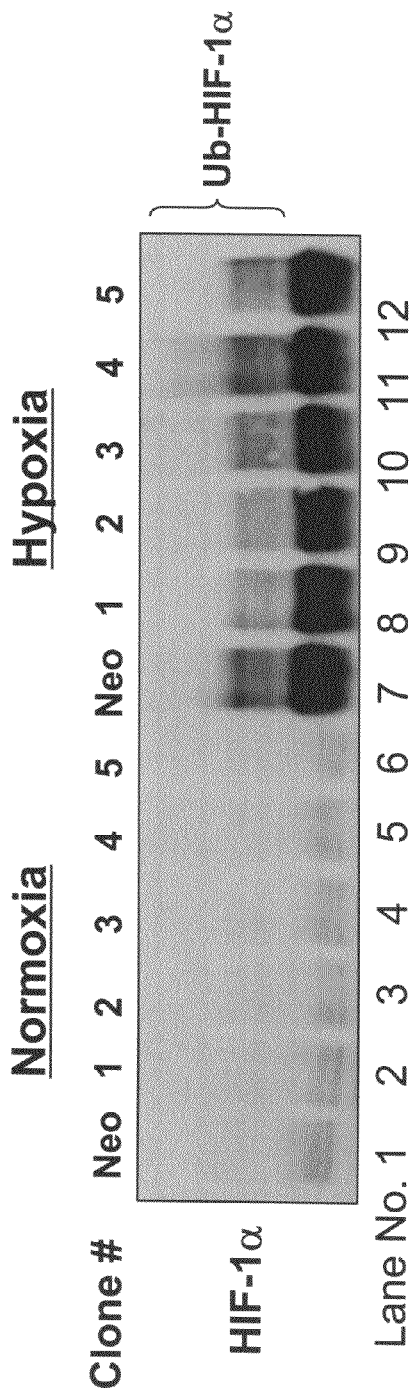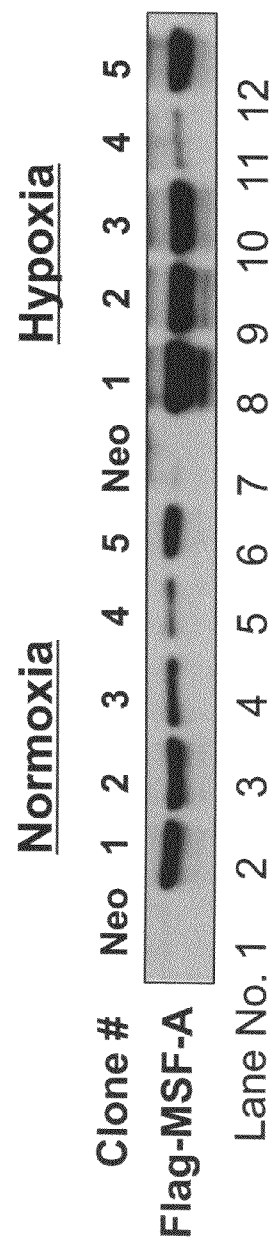
Fig. 18a
Fig. 18b

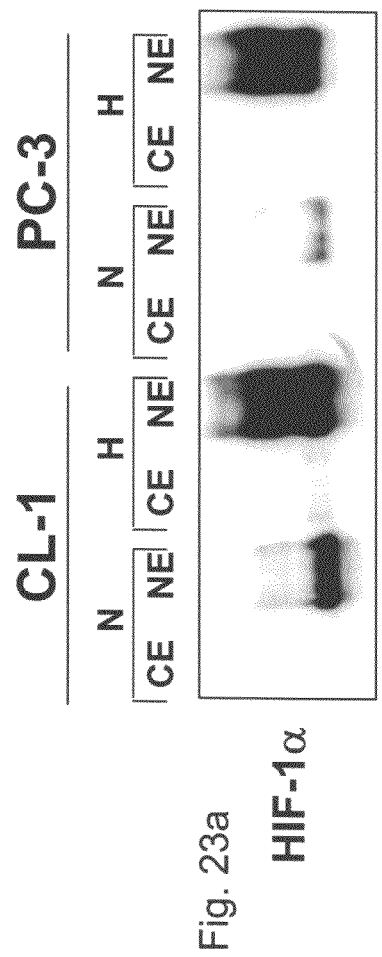
Fig. 23a  HIF-1α
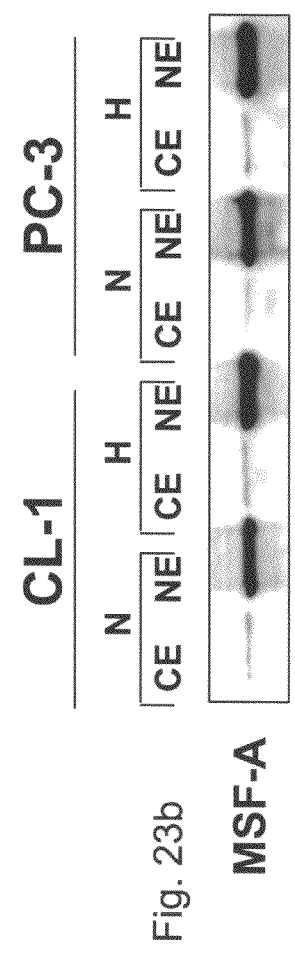
Fig. 23b  MSF-A
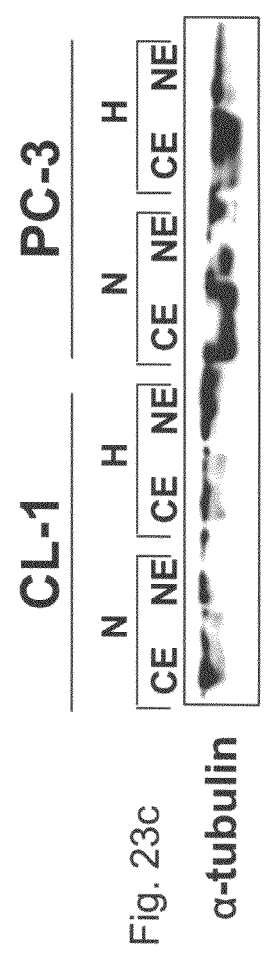
Fig. 23c  α-tubulin

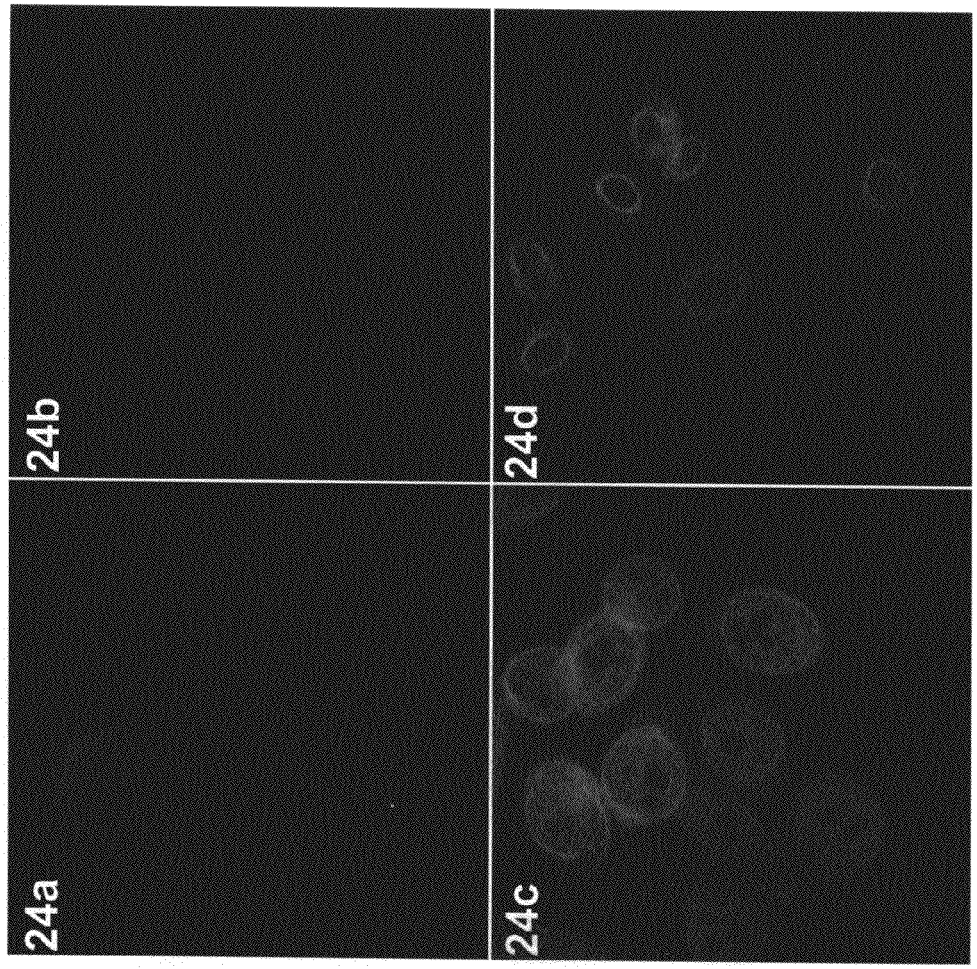
Figs. 24a-d

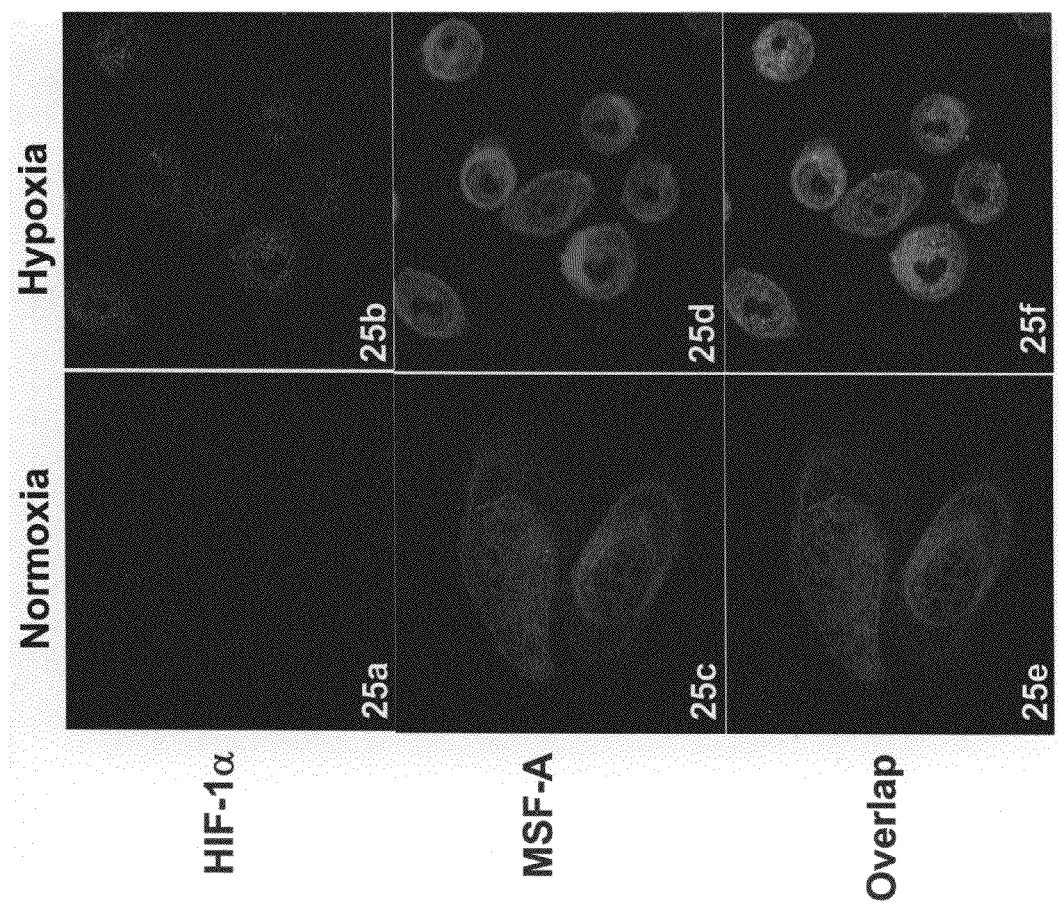
Figs. 25a-f

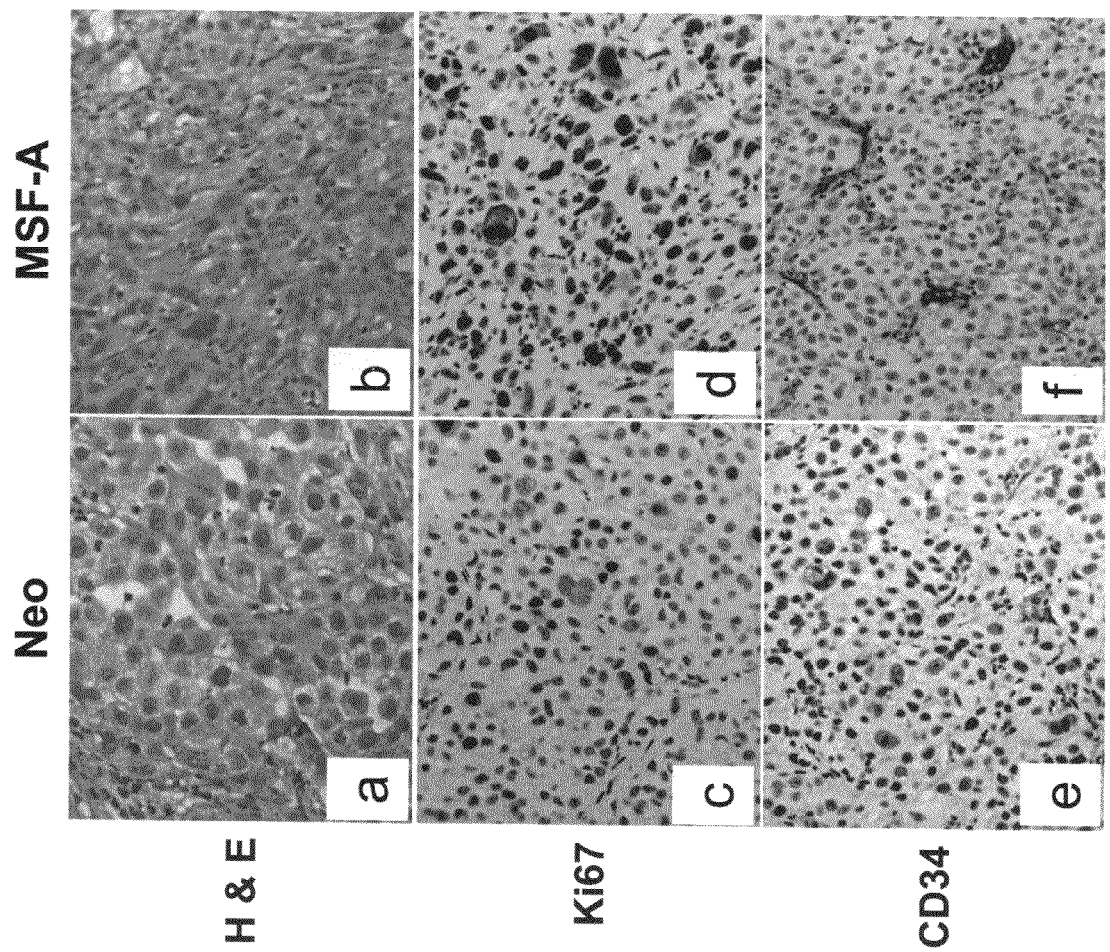
Figs. 30a-f

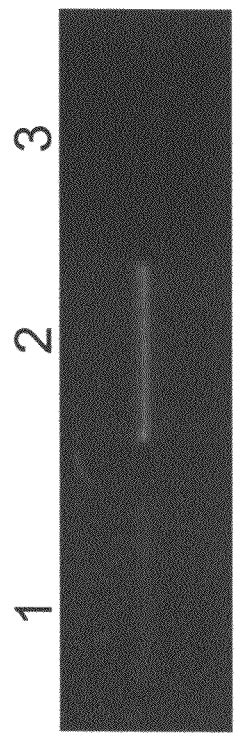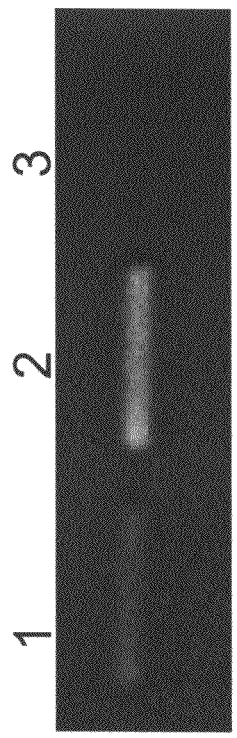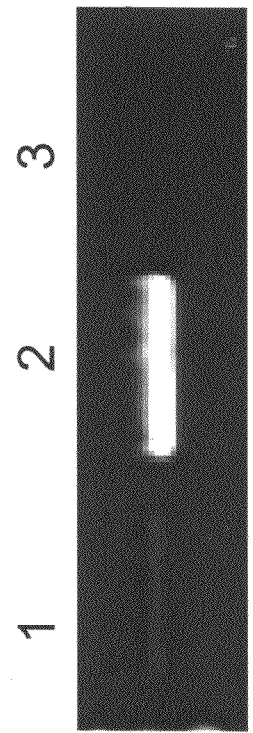

MSF-A

β-actin

AGENTS CAPABLE OF DOWNREGULATING AN MSF-A DEPENDENT HIF-1α AND USE THEREOF IN CANCER TREATMENT

RELATED APPLICATIONS

This Application is a National Phase of PCT Patent Application No. PCT/IL2005/000736 having International Filing Date of Jul. 12, 2005, which claims the benefit of U.S. Provisional Patent Application No. 60/586,697 filed on Jul. 12, 2004. The contents of the above Applications are all incorporated herein by reference.

FIELD AND BACKGROUND OF THE INVENTION

The present invention relates to agents which can prevent the formation of, or dissociate or destabilize an MSF-A-HIF1α protein complex and, more particularly, to the use of such agents in treating cancer.

Hypoxia-inducible factors (HIFs) are transcription factors involved in the transcription activation of several genes including, angiogenic factors (e.g., VEGF and FLT1), glucose transporters (Glut-1 and Glut-3), and glycolytic enzymes which are involved in the production of ATP in the absence of $O_2$ (for overview see Semenza G L. 2003; Nat. Rev. Cancer 3: 721-732; Paul S A, Simons J W, Mabjeesh N J. 2004; J. Cell Physiol. 200: 20-30). HIF transcription factors are composed of two subunits, HIF-α and HIF-β. While the HIF-β is constitutively expressed, the expression of HIF-α is regulated by the level of oxygen. Thus, in the presence of normal oxygen tension (i.e., normoxia), HIF-1α is hydroxylated at the two critical proline residues (402 and 564 of GenBank Accession No. NP_001521) by members of the prolyl hydroxylase protein (PHD) family (PHD-1, -2, and -3). Hydroxylated-HIF-1α can then bind the von Hippel-Lindau (VHL) tumor suppressor protein, which recruits the E3 ubiquitin-ligase complex to targeting the HIF-α protein to proteasomal degradation. However, since oxygen is the rate-limiting co-factor of PHD enzymes, at low oxygen tension (i.e., hypoxia conditions), the prolyl hydroxylases are unable to hydroxylate HIF-α. As a result, no VHL interaction occurs and the E3 ubiquitin-ligase complex is unable to target HIF-1α to proteasomal degradation, resulting in stabilization of HIF. Stabilized HIF-1α can then form a heterodimer with the HIF-1β, which interacts with the basic helix-loop-helix domain of the hypoxia response element (HRE) in target genes.

In addition, hydroxylation of an asparagine residue in the C-terminal transactivation domain (TAD) of HIF-α (at position 803) by the factor inhibiting HIF-1 (FIH-1) negatively regulates transcriptional activity of HIF by preventing its interaction with p300 and CBP transactivators.

Elevated levels of HIF-1α protein are found in the majority of solid tumors and cancer metastases in the areas of profound hypoxia (Quintero M, Mackenzie N, Brennan P A. 2004; Eur. J. Surg. Oncol. 30: 465-8). In addition, a number of oncogenes such as AKT, Src, and oncogenic Ras were found to induce HIF expression (Li J, et al., 2004; Cancer Res. 64: 94-101). Moreover, p53 and Hsp90 were found to positively and negatively regulate HIF-1α degradation, respectively, i.e., while under normoxia P53 promotes HIF-1α degradation (Choi K S et al., 2003; J. Biochem. Mol. Biol. 36: 120-7), Hsp90 has a protective role in VHL-independent degradation of HIF-1α (Isaacs J S et al., J. Biol. Chem. 2004; 279: 16128-35). In addition, in many cases, the major reason for the failure of cancer therapy is the resistance of hypoxic cancer cells to both chemotherapy and radiation (Escuin D et al., 2004; Cancer Biol Ther. 3(7). Epub ahead of print). Thus, HIF-1α has been recognized as a possible target for anti cancer therapy (Welsh S J and Powis G. 2003; Curr Cancer Drug Targets. 3(6): 391-405; Macpherson G R and Figg W D, 2004; Cancer Biol. Ther. 3(6). Epub ahead of print).

Several agents capable of downregulating HIF-1 have been identified as potential anti-cancer agents including FK228, a histone deacetylase (HDAC) inhibitor (Mie Lee Y et al., 2003. Biochem. Biophys. Res. Commun. 300: 241-6), PX-478, a small-molecule HIF-1 inhibitor, (Macpherson G R, Figg W D. 2004. Cancer Biol. Ther. 3(6) Epub ahead of print) and Bisphenol A, an environmental endocrine-disrupting chemical (Kubo T et al., 2004; Biochem. Biophys. Res. Commun. 318(4): 1006-11). However, although desired, the mechanisms leading to up- or down-regulation of HIFs in cancerous tumors are not yet clear, thus, limiting the use of HIF-1 inhibitors/suppressors as anti cancer agents.

While reducing the present invention to practice, the present inventor has uncovered that MSF-A, a myeloid/lymphoid leukemia septin-like fusion protein A, regulates HIF-1α activity and thus contributing to cancer progression.

SUMMARY OF THE INVENTION

According to one aspect of the present invention there is provided a method of treating cancer and/or inhibiting a growth of a cancerous tumor and/or metastases in an individual comprising providing to the individual an agent capable of downregulating an MSF-A-dependent HIF-1α activity in cells of the individual thereby treating the cancer and/or inhibiting the growth of the cancerous tumor and/or the metastases in the individual.

According to another aspect of the present invention there is provided an antibody or antibody fragment capable of specifically binding to an MSF-A polypeptide.

According to yet another aspect of the present invention there is provided a method of treating acute ischemia in cells of an individual comprising providing to the individual an agent capable of increasing an MSF-A-dependent HIF-1α activity in cells of the individual to thereby treat the acute ischemia.

According to still another aspect of the present invention there is provided a method of identifying putative anti cancer agents, the method comprising identifying agents being capable of preventing the formation of and/or dissociating an MSF-A-HIF-1α protein complex, thereby identifying the putative anti cancer agents.

According to an additional aspect of the present invention there is provided a method of determining if a molecule is capable of preventing the formation of and/or dissociating an MSF-A-HIF-1α protein complex, comprising incubating the MSF-A-HIF-1α protein complex or cells harboring the MSF-A-HIF-1α protein complex with the molecule and determining the presence or absence of the MSF-A-HIF-1α protein complex following the incubating, wherein the absence of the MSF-A-HIF-1α protein complex is indicative of the capacity of the molecule to prevent the formation of and/or dissociate the MSF-A-HIF-1α protein complex.

According to yet an additional aspect of the present invention there is provided a method of determining the prognosis of an individual having cancer, comprising determining the presence or absence of an MSF-A-HIF-1α protein complex in cancerous cells derived from the individual, wherein the presence of the MSF-A-HIF-1α protein complex is indicative of poor prognosis of the individual.

According to further features in preferred embodiments of the invention described below, downregulating the MSF-A-dependent HIF-1α activity is effected by preventing a formation of an MSF-A-HIF-1α complex and/or dissociating the MSF-A-HIF-1α complex.

According to still further features in the described preferred embodiments the agent capable of preventing formation of the MSF-A-HIF-1α complex is capable of downregulating and/or preventing an association between MSF-A and HIF-1α.

According to still further features in the described preferred embodiments the agent capable of preventing the formation of and/or dissociating the MSF-A-HIF-1α protein complex is selected from the group consisting of an MSF-A antisense oligonucleotide, an MSF-A siRNA, an MSF-A DNAzyme, an MSF-A Ribozyme, an MSF-A antibody or antibody fragment, a non-functional MSF-A polypeptide, an MSF-A derived peptide or peptide analog, a non-functional HIF-1α polypeptide and an HIF-1α derived peptide or peptide analog.

According to still further features in the described preferred embodiments the MSF-A antibody or antibody fragment is capable of specifically binding to the polypeptide set forth by SEQ ID NO:3.

According to still further features in the described preferred embodiments the non-functional MSF-A polypeptide is set forth by SEQ ID NO:10.

According to still further features in the described preferred embodiments the MSF-A derived peptide or peptide analog includes the amino acid sequence set forth in SEQ ID NOs:2463-4193 or 4213.

According to still further features in the described preferred embodiments the HIF-1α derived peptide or peptide analog includes the amino acid sequence set forth in SEQ ID NOs:12-2462.

According to still further features in the described preferred embodiments the cancer and/or the cancerous tumor is selected from the group consisting of prostate cancer, breast cancer, chemotherapy-induced MLL, stomach cancer, cervical cancer, endometrial cancer, and ovarian cancer.

According to still further features in the described preferred embodiments the antibody is capable of preventing the formation of and/or dissociating an MSF-A-HIF-1α protein complex.

According to still further features in the described preferred embodiments the acute ischemia is a result of stroke and/or acute myocardium infraction.

According to still further features in the described preferred embodiments increasing the MSF-A-dependent HIF-1α activity is effected by upregulating formation of an MSF-A-HIF-1α protein complex and/or stabilizing the MSF-A-HIF-1α protein complex.

According to still further features in the described preferred embodiments the agent capable of upregulating the MSF-A-HIF-1α protein complex is capable of increasing the association between MSF-A and HIF-1α.

According to still further features in the described preferred embodiments the agent capable of upregulating and/or stabilizing the MSF-A-HIF-1α protein complex is selected from the group consisting of an exogenous polynucleotide encoding at least a functional portion of MSF-A, an exogenous polynucleotide encoding at least a functional portion of HIF-1α, an exogenous polypeptide including at least a functional portion of MSF-A, an exogenous polypeptide including at least a functional portion of HIF-1α, a polypeptide capable of stabilizing the MSF-A-HIF-1α protein complex.

According to still further features in the described preferred embodiments the agents are selected from the group consisting of chemicals, antibodies, aptamers, peptides, and peptide analogs.

According to still further features in the described preferred embodiments the peptide or peptide analog is derived from MSF-A or HIF-1α.

According to still further features in the described preferred embodiments the peptide or peptide analog includes the amino acid sequence set forth in SEQ ID NOs: 2463-4193, 4213 or 12-2462.

According to still further features in the described preferred embodiments incubating is effected for a time period selected from the range of 1-48 hours.

According to still further features in the described preferred embodiments the presence or the absence of the MSF-A-HIF-1α protein complex is effected using anti-MSF-A and/or anti-HIF-1α antibody.

According to still further features in the described preferred embodiments determining the presence or the absence of the MSF-A-HIF-1α protein complex is effected by sequentially and/or simultaneously exposing the MSF-A-HIF-1α protein complex or the cells harboring the MSF-A-HIF-1α protein complex to the anti-MSF-A and the anti-HIF-1α antibodies.

According to still further features in the described preferred embodiments determining the presence or the absence of the MSF-A-HIF-1α protein complex is effected using an immunological detection method.

According to still further features in the described preferred embodiments the immunological detection method utilizes an anti-MSF-A and/or an anti-HIF-1α antibody or antibody fragment.

The present invention successfully addresses the shortcomings of the presently known configurations by providing methods of treating cancer or acute ischemia.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting.

BRIEF DESCRIPTION OF THE DRAWINGS

The file of this patent contains at least one drawing executed in color photograph. Copies of this patent with color photograph(s) will be provided by the Patent and Trademark Office upon request and payment of necessary fee.

The invention is herein described, by way of example only, with reference to the accompanying drawings. With specific reference now to the drawings in detail, it is stressed that the particulars shown are by way of example and for purposes of illustrative discussion of the preferred embodiments of the present invention only, and are presented in the cause of providing what is believed to be the most useful and readily understood description of the principles and conceptual aspects of the invention. In this regard, no attempt is made to show structural details of the invention in more detail than is necessary for a fundamental understanding of the invention, the description taken with the drawings making apparent to those skilled in the art how the several forms of the invention may be embodied in practice.

In the drawings:

FIG. 1 is an autoradiogram illustrating HIF-1α-immunoprecipitation from whole cell lysates of $^{35}$S-metabolically labeled PC-3 cells.

FIG. 2 is a Western Blot analysis illustrating the expression of recombinant MSF-A protein in HEK 293 transfected cells. HEK 293 cells were transiently transfected with the p3xFlag-MSF-A vector and the expression of the recombinant MSF-A protein was detected at the indicated time points using an anti-Flag antibody (Sigma-Aldrich Corp., St Louis, Mo., USA).

Figure 3A:
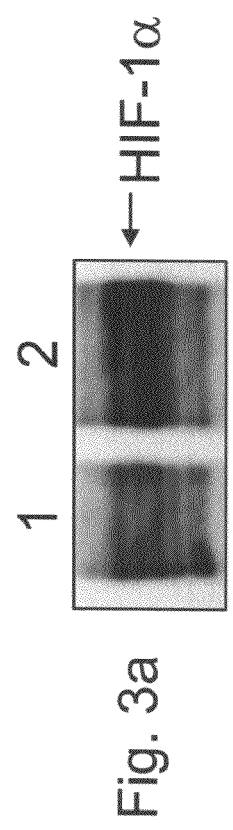
Figure 3B:
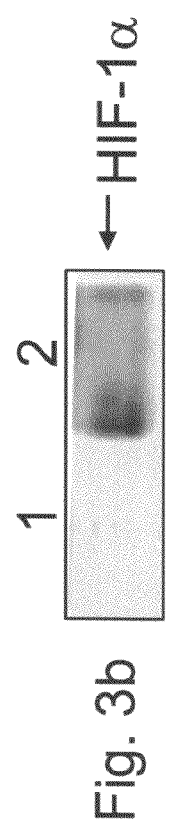
Figure 3C:
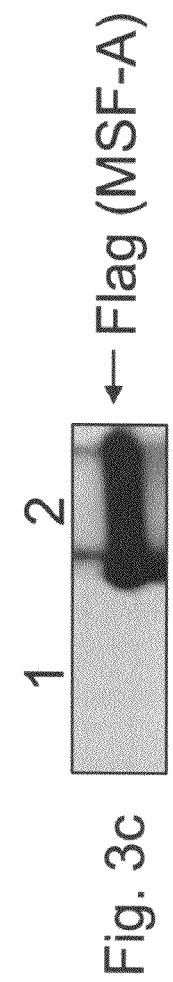
Figure 3D:
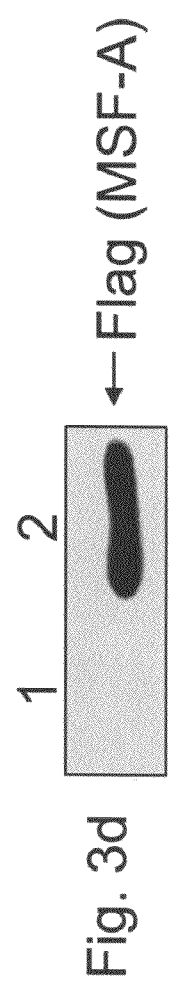
Figure 3E:
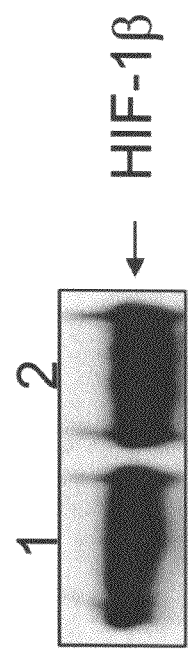
Figure 3F:
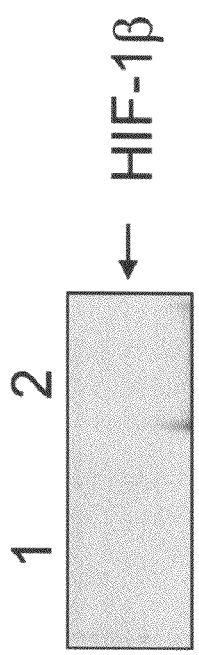

FIGS. 3a-f are autoradiograms illustrating HIF-1α immunoblotting of FLAG immunoprecipitates (IP) (FIG. 3b) or whole cell extracts (WCE) (FIG. 3a), FLAG immunoblotting of HIF-1α IP (FIG. 3d) or WCE (FIG. 3c), and HIF-1β immunoblotting of FLAG IP (FIG. 3f) or WCE (FIG. 3e). HEK 293 cells were transiently co-transfected with two of the following expression vectors: p3xFlag-cmv-25 (EV), pcdna3.1-HIF-1α (HIF-1α) or p3xFlag-MSF-A (MSF-A), and two days following transfection under normoxic conditions WCE or IP were subjected to immunoblot (IB) analysis. Lane 1-EV and HIF-1α; lane 2-MSF-A and HIF-1α.

Figure 4A:
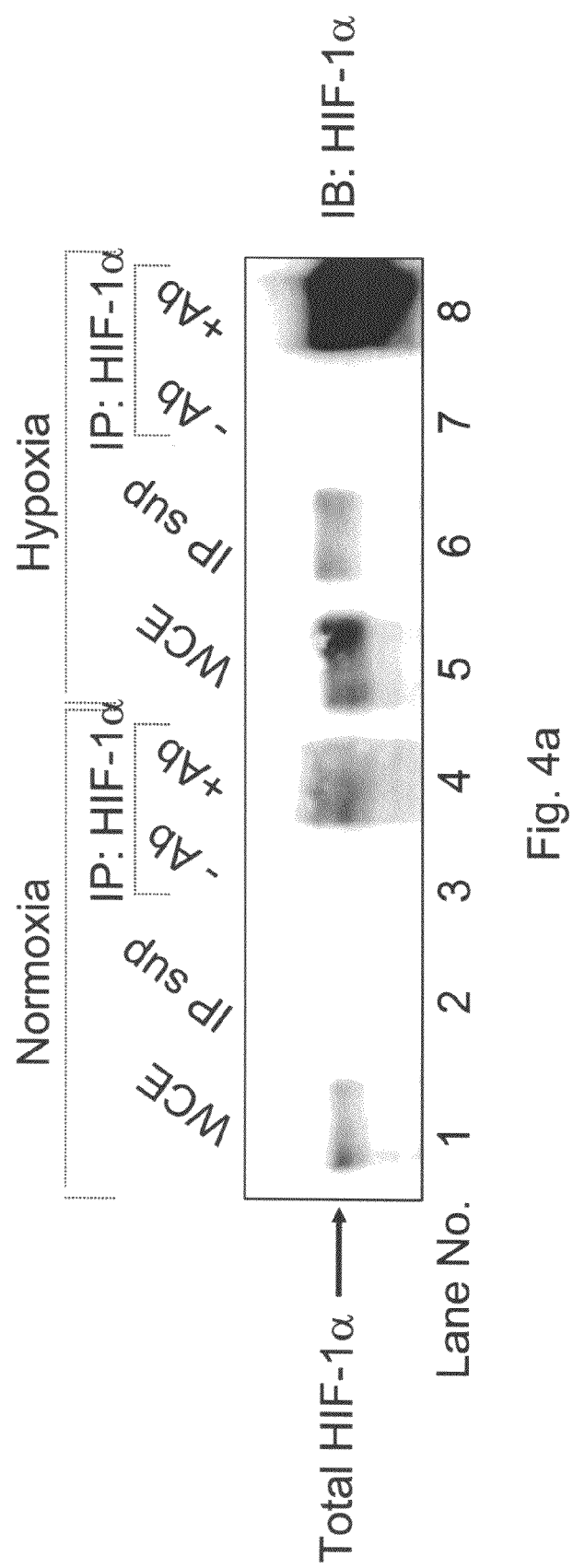
Figure 4B:
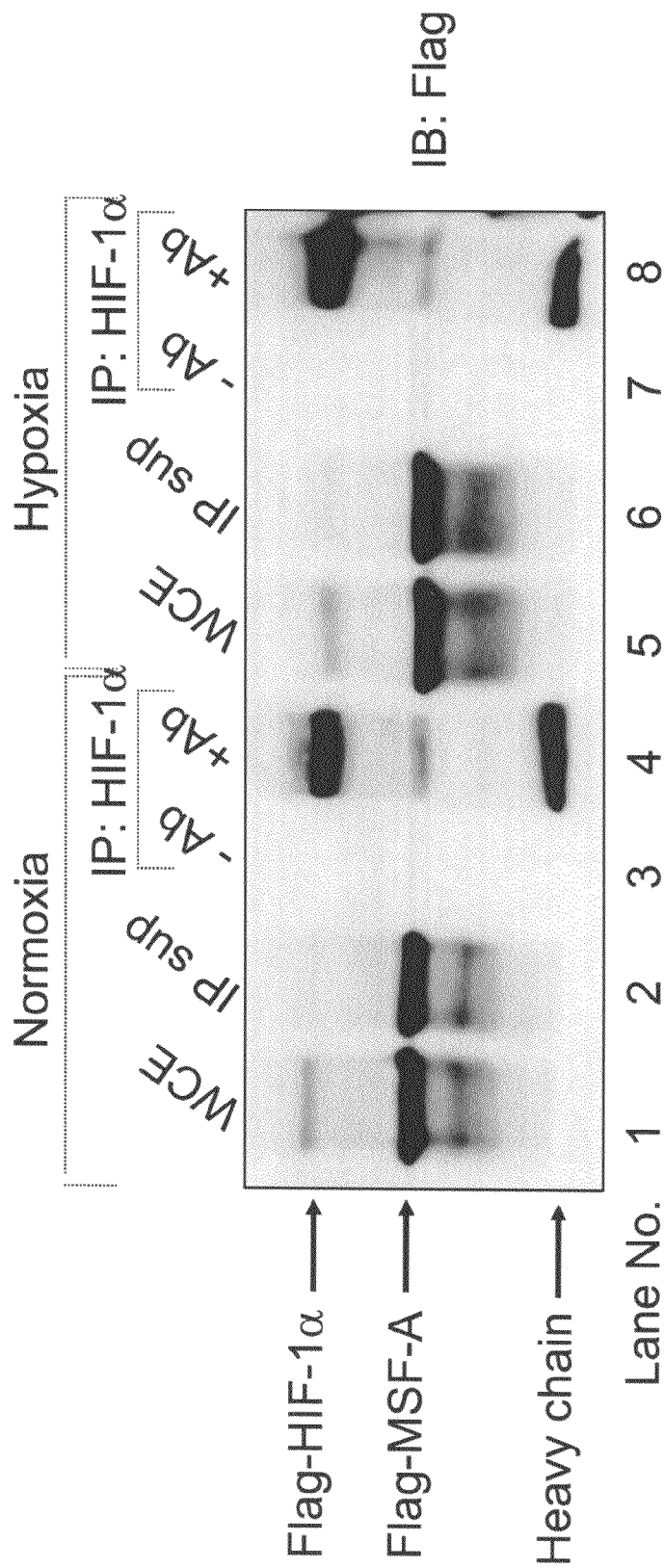

FIGS. 4a-b are autoradiograms depicting HIF-1α (FIG. 4a) or Flag (FIG. 4b) immunoblotting of HIF-1α immunoprecipitates. HEK 293 cells were co-transfected with the p3xFlag-HIF-1α and p3xFlag-MSF-A vectors and 24 hours following transfection the cell were subjected to either normoxia (lanes 1-4) or hypoxia (lanes 5-8) for another 24 hours. Lanes 1 and 5=WCE, lanes 2 and 6=IP sup, lanes 3 and 7=HIF-1α IP without an antibody (negative control), lanes 4 and 8=HIF-1α IP; WCE=whole cell extracts; IP sup=immunoprecipitation supernatant; Ab=antibody.

Figure 5A:
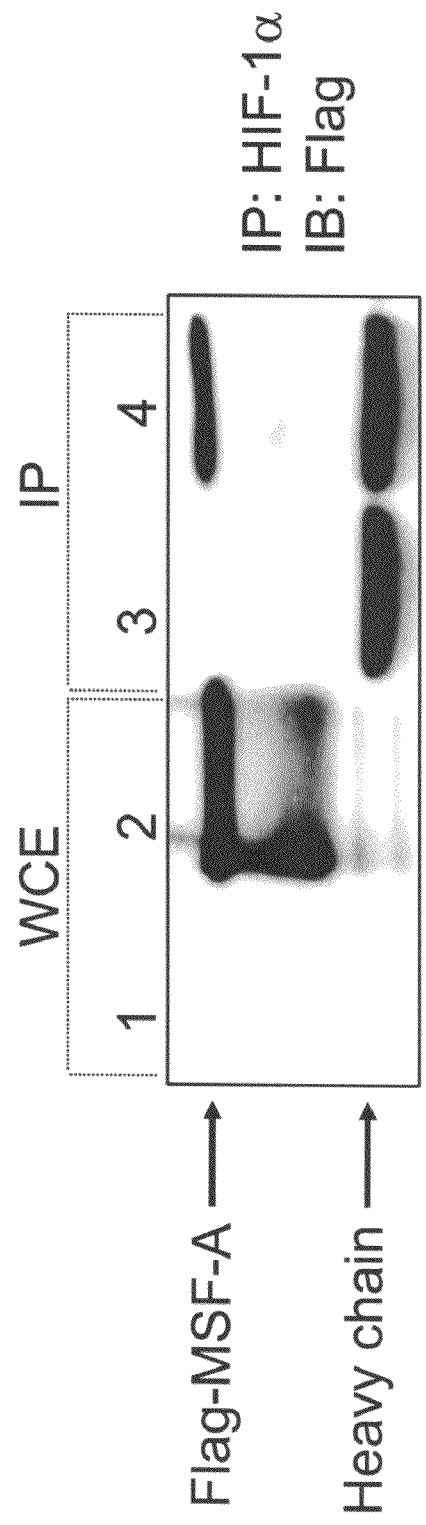
Figure 5B:
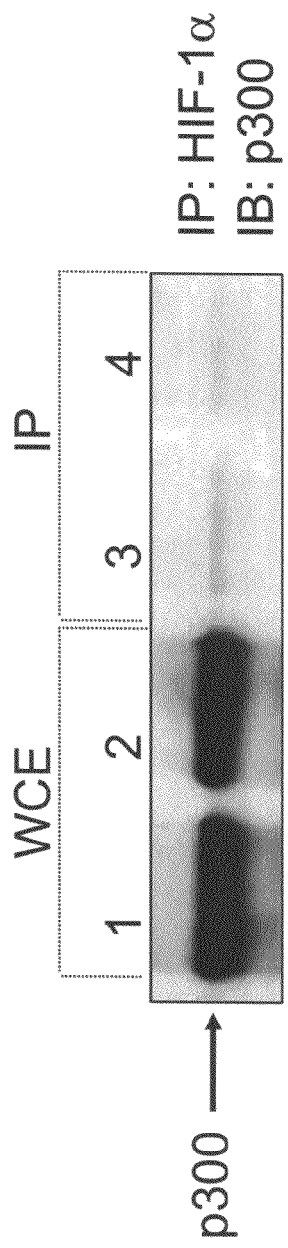
Figure 5C:
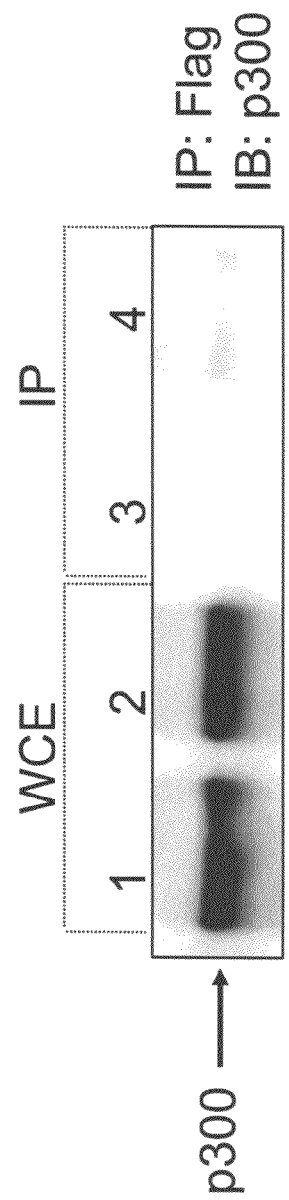

FIGS. 5a-c are autoradiograms illustrating MSF-A association to the HIF-1α complex. HEK 293 cells were co-transfected with two of the three expression vectors as in FIGS. 3a-f, and two days following transfection the cells were subjected to IP analysis using anti-HIF-1α (FIGS. 5a-b) or anti-Flag (FIG. 5c) antibodies, followed by IB using the anti-Flag (FIG. 5a) or anti-p300 (FIGS. 5b-c; Santa Cruz Biotechnology Inc., Santa Cruz, Calif.) antibodies. Lanes 1 and 3-EV and HIF-1α; lanes 2 and 4-MSF-A and HIF-1α.

Figure 6:
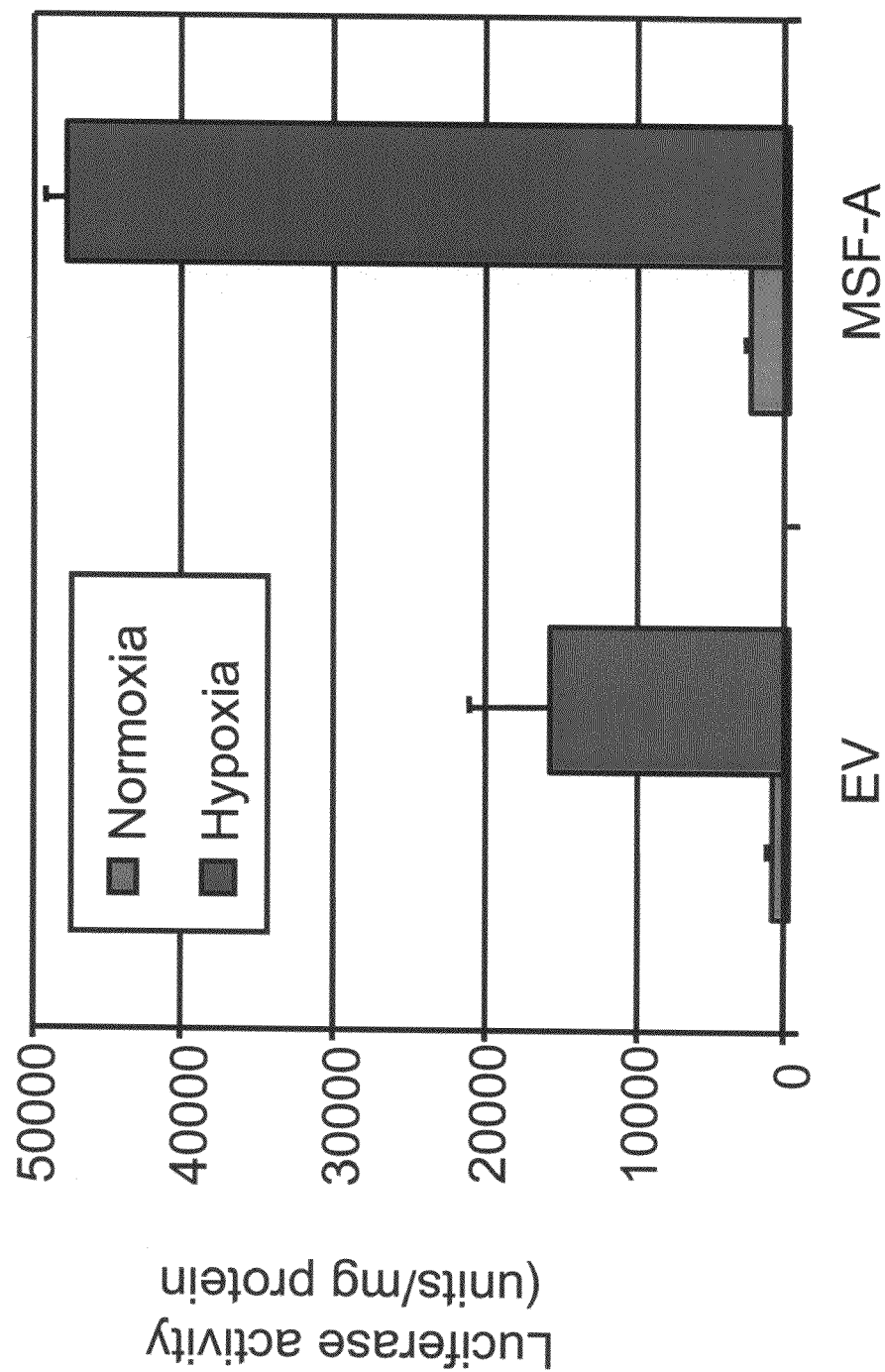

FIG. 6 is a graph illustrating reporter gene activity under normoxia or hypoxia. PC-3 cells were co-transfected with a plasmid expressing the luciferase gene under the control of hypoxia response element (HRE) and with either the p3xFlag-cmv-25 (EV) or the p3xFlag-MSF-A vector. Twenty-four hours following transfection, cells were left under normoxia or were subjected to hypoxia for overnight, following which the luciferase luminescence assay was employed. Results are expressed as average of triplicates. P value<0.05.

Figure 7:
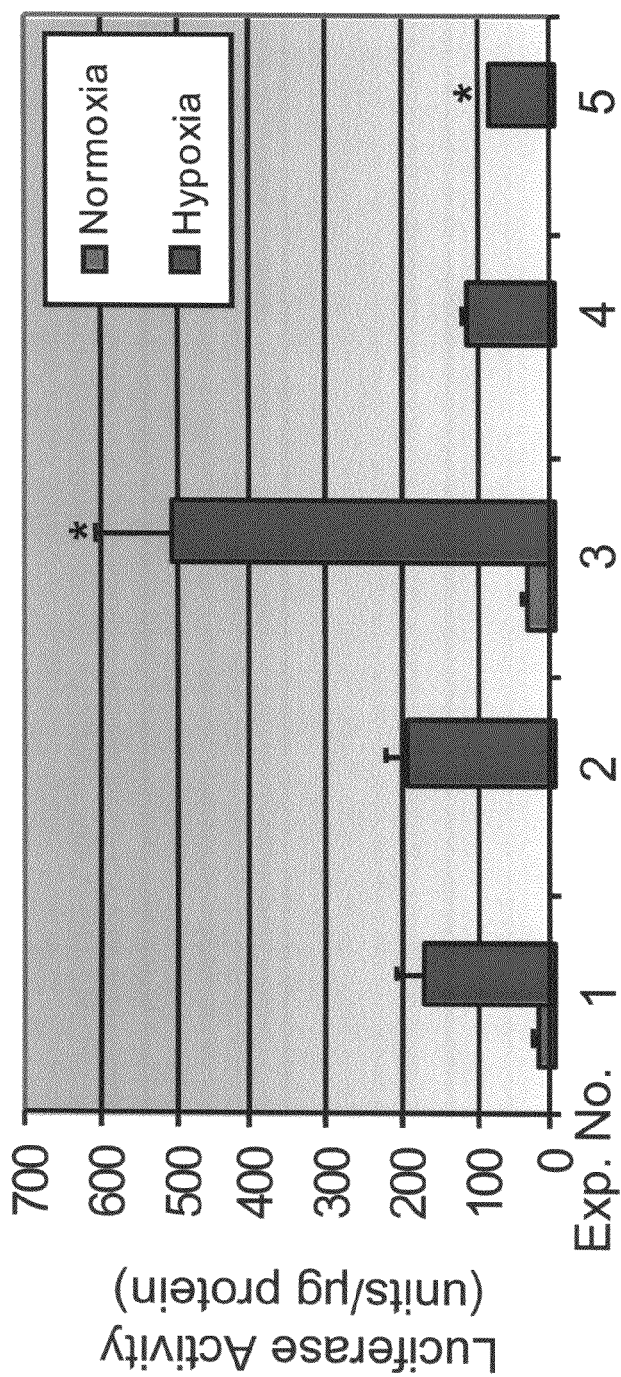

FIG. 7 is a graph depicting luciferase activity (a reporter of HIF-1α transcriptional activation) as a function of the presence or absence of the N-terminus of the MSF-A protein. HEK 293 cells were co-transfected with 0.1 μg HRE-dependent luciferase reporter [pBI-GL V6L (Post, D. E., and Van Meir, E. G. 2001. Generation of bidirectional hypoxia/HIF-responsive expression vectors to target gene expression to hypoxic cells. Gene Ther 8, 1801-1807. Mabjeesh, N. J., et al., 2002, Geldanamycin induces degradation of hypoxia-inducible factor 1 alpha protein via the proteasome pathway in prostate cancer cells. Cancer Res 62, 2478-2482) and the wild type (WT) MSF-A (p3xFlag-MSF-A), ΔN-MSF-A (ΔN) (p3xFlag-ΔN-MSF-A) or empty vector (EV) (p3xFlag-cmv-25) constructs as follows: Experiment (Exp.) No. 1=1 μg EV; Exp. No. 2=0.5 μg EV and 0.5 μg WT; Exp. No. 3-1 μg WT; Exp. No. 4=0.5 μg EV and 0.5 μg ΔN; Exp. No. 5=1 μg ΔN.

After 24 hours of transfection, cells were subjected to normoxia or hypoxia for overnight and then analyzed for luciferase luminescence assay. Luciferase activity is presented as relative units per μg protein in each experiment. Columns represent means; bars represent SD; n=3; *, p<0.05 compared to hypoxia of EV. Note the significant decrease of luciferase activity in cells grown under hypoxia and transfected with the N-terminus truncated form (ΔN) of MSF-A as compared with cells transfected with the wild-type form of MSF-A. Also note that under normoxia, when the luciferase activity is hardly detected, no significant difference is obtained.

Figure 8:
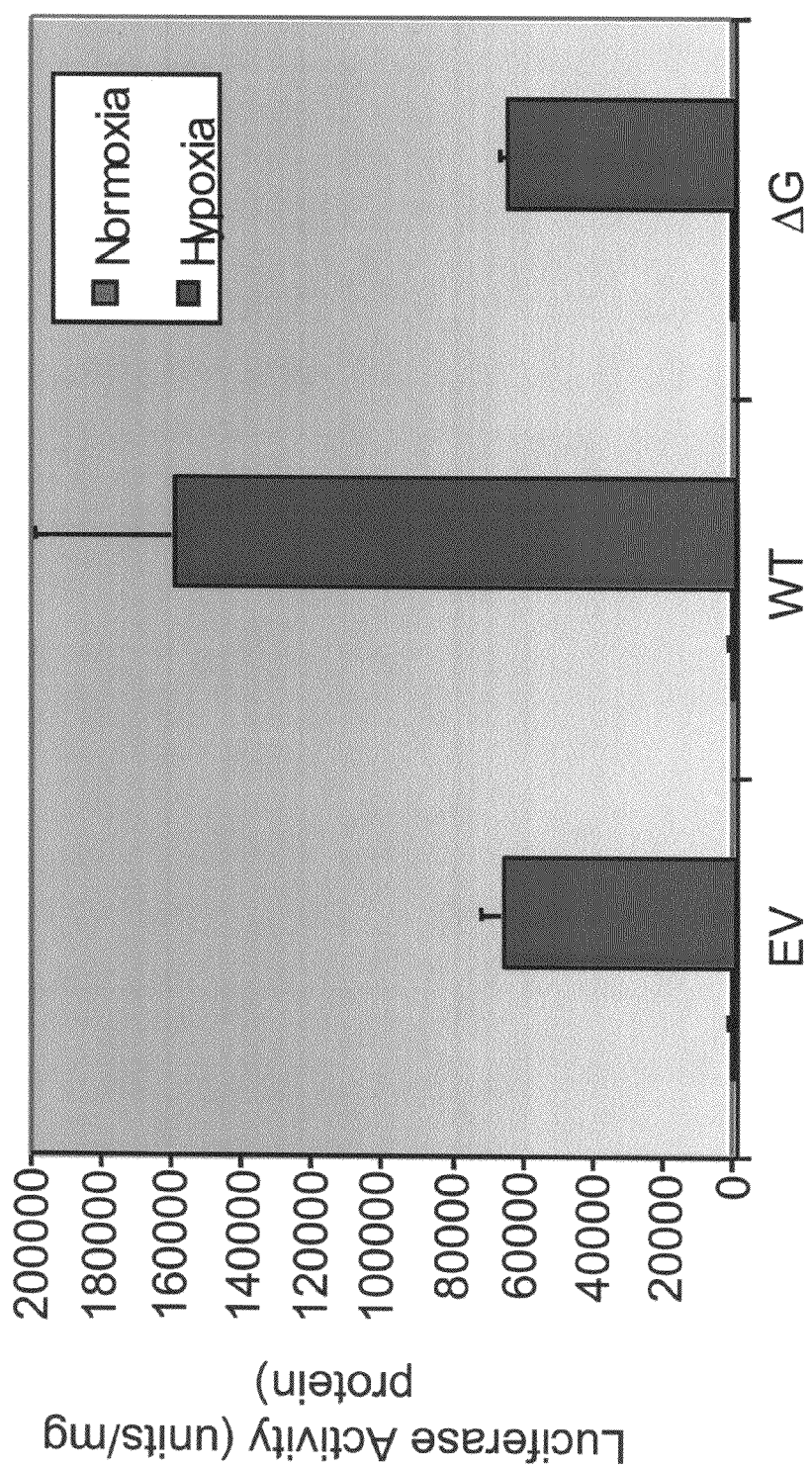

FIG. 8 is a graph depicting luciferase activity (a reporter of HIF-1α transcriptional activation) as a function of the presence or absence of the GTP binding site of MSF-A (ΔG). HEK 293 cells were cotransfected with HRE-dependent luciferase reporter and the expression vector encoding wild-type MSF-A (WT) (p3xFlag-MSF-A), the deleted GTP binding site form of MSF-A (ΔG) (p3xFlag-ΔG-MSF-A) or empty vector (EV) (p3xFlag-cmv-25) and then were exposed to hypoxia conditions as described in the description of FIG. 4, hereinabove. Luciferase activity is presented as relative units per μg protein in each experiment. Columns represent means; bars represent SD; n=3. Note the non-significant effect of the ΔG-MSF-A on HIF-1α activity.

Figure 9A:
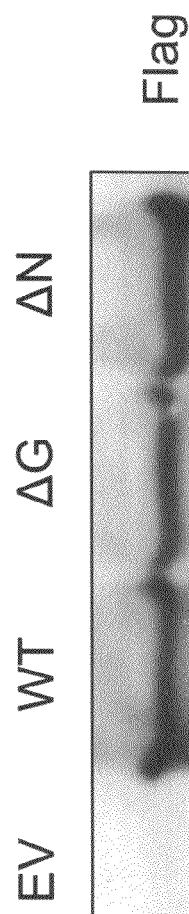
Figure 9B:
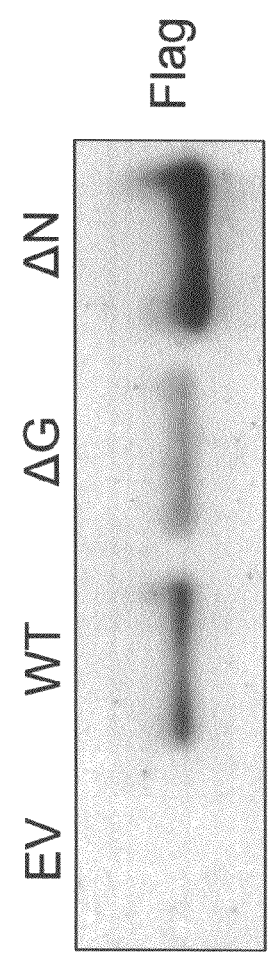
Figure 9C:
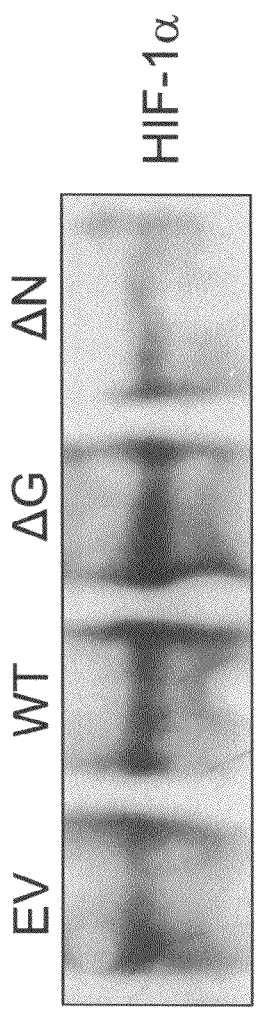

FIGS. 9a-c are Western blot analyses of FLAG (MSF-A; FIGS. 9a and b) and HIF-1α (FIG. 9c) depicting the interaction between HIF-1α and the WT or deleted forms of MSF-A. HEK 293 cells were transiently co-transfected with expression vector encoding Flag-MSF-A (WT; p3xFlag-MSF-A), Flag-ΔG (ΔG; p3xFlag-ΔG-MSF-A), Flag-ΔN (ΔN; p3xFlag-ΔN-MSF-A) or empty vector (EV; p3xFlag-cmv-25). After 48 hours, the cells were lysed, subjected for immunoprecipitation (IP) using HIF-1α antibody and then immunoblotted (IB) with HIF-1α or Flag antibodies. FIG. 9a—whole cell extracts (WCE) subjected to IB with the Flag antibody (MSF-A); FIG. 9b—IP prepared by the HIF-1α antibody were subjected to IB with the Flag antibody (MSF-A); FIG. 9c—IP prepared by the HIF-1α antibody were subjected to IB with the HIF-1α antibody.

FIGS. 10a-b depict MSF-A expression (FIG. 10a) and activation of HIF-1α (FIG. 10b) in MSF-A stably transfected PC-3 cells. FIG. 10a is an immunoblot of PC-3 cells stably transfected with the MSF-A vector (p3xFLAG-MSF-A; clones numbers 8, 9, 10, 11, 12, 13, 15, 16, 17, 20, 22, 23, 24, 25, 28, 29, 30) or the EV (p3xFlag-cmv-25) using the anti-Flag antibody. Neomycin-resistant clones were grown under normoxic conditions, harvested and analyzed for MSF-A expression by immunoblotting with Flag antibody. Note the high expression level of MSF-A in stably transfected clones numbers (#) 7, 8, 9, 10, 11, 12, 13, 15, 16, and 17. FIG. 10b is a graph depicting luciferase activity in various stably MSF-A transfected cells. Parental PC-3 cells and selected stably transfected clones [transfected with the EV or MSF-A (clone numbers 7, 11 and 25)] were transiently transfected with 1 μg of the HRE-dependent luciferase reporter (pBI-GL V6L) for HIF-1 transcriptional activity. Luciferase activity is presented in units per mg protein in each transfected cells. Columns=means; bars=SD; n=3; *, p<0.05 compared to hypoxia of EV.

Figure 11:
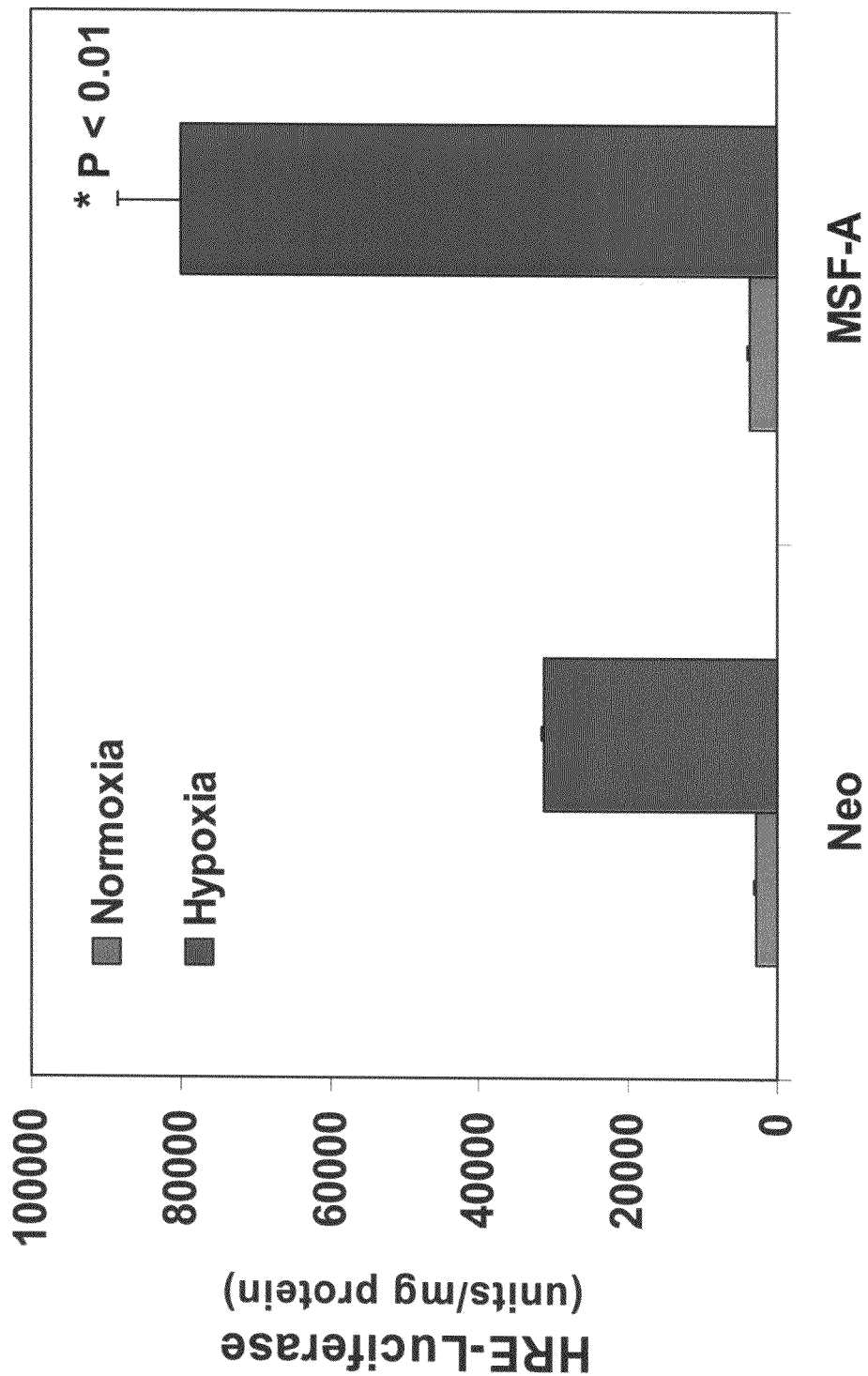

FIG. 11 is a graph depicting enhancement of luciferase activity in cells stably transfected with MSF-A. Pooled clones of PC-3 cells stably transfected with the MSF-A expression vector (MSF-A) or the empty vector (Neo) were subjected to reporter luciferase assay under normoxia or hypoxia conditions. Note the significant difference in luciferase activity under hypoxia in cells stably expressing the MSF-A protein as compared with cells transfected with the empty vector.

FIGS. 12a-f are RT-PCR analyses depicting HIF-1α mediated activation of various genes in cells transfected with the expression vector alone (Neo) or the MSF-A expression vector (MSF-A). Total RNA was isolated from PC-3-Neo and PC-3-MSF-A cells grown under normoxic (lanes 1 and 2) and hypoxic (lanes 3 and 4) conditions. Semi-quantitative RT-PCR analysis was performed using VEGF, Glut-1, ET-1, CA-IX, HIF-1α and β-actin primers (SEQ ID NOs:4200-4211 as described under General Materials and Experimental Methods). Lane 1—Neo, lane 2—MSF-A, lane 3—Neo, lane 4—MSF-A, lane 5—water (negative control). Note the significant increased expression of VEGF in PC-3-MSF-A cells grown under hypoxia (lane 4 in FIG. 12a) as compared with PC-3-MSF-A cells grown under normoxia (lanes 2 in FIG. 12a) as well as compared with PC-3-Neo cells grown under either hypoxia (lane 3 in FIG. 12a) or normoxia (lane 1 in FIG. 12a).

Figure 13:
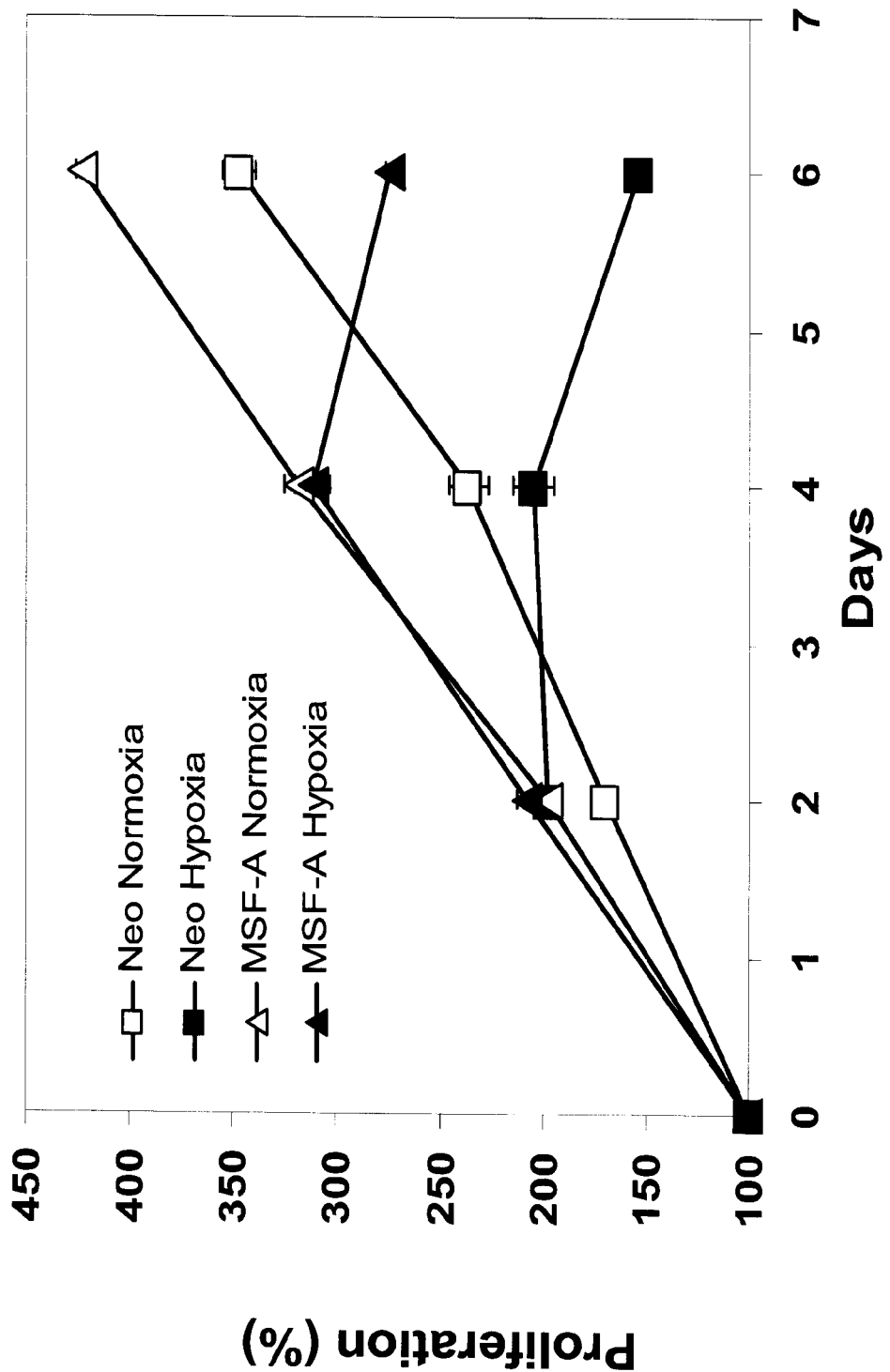

FIG. 13 is a graph depicting the effect of MSF-A over-expression on cell proliferation. PC-3-Neo and PC-3-MSF-A cells were grown under normoxic and hypoxic conditions for the indicated time and then analyzed for proliferation using XTT assay. Proliferation was expressed as increase in % of the initial O.D. measured on the next day of seeding which was considered 100%. Growth media were not changed until the end of the experiment.

Figure 14G:
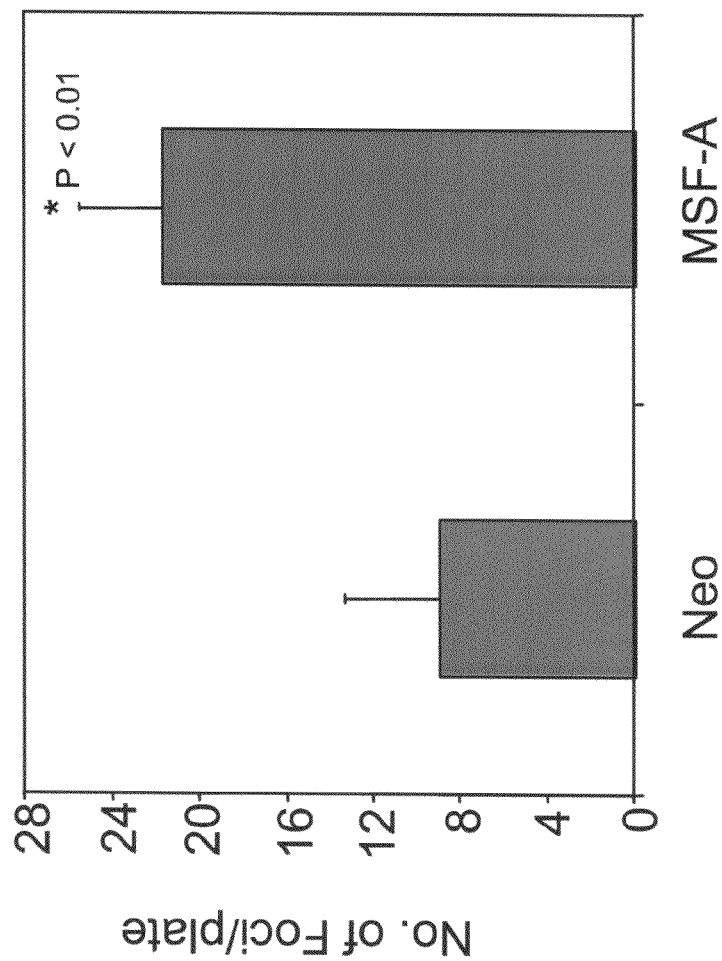

FIGS. 14a-g are microscopic photographs (FIGS. 14a-f) and a graph depicting the effect of MSF-A over-expression on colony formation and growth (FIG. 14g). PC-3-Neo and PC-3-MSF-A cells were grown for 4 weeks in soft agar under normoxic conditions. Colonies were observed and counted. FIGS. 14a, c, and e—representative colonies from each plate seeded with PC-3-Neo cells; FIGS. 14b, d, and f—representative colonies from each plate seeded with PC-3-MSF-A cells; FIG. 14g—quantitative analysis of colony number from each cell type. Columns=means; bars=SD; n=3.

Figure 15A:
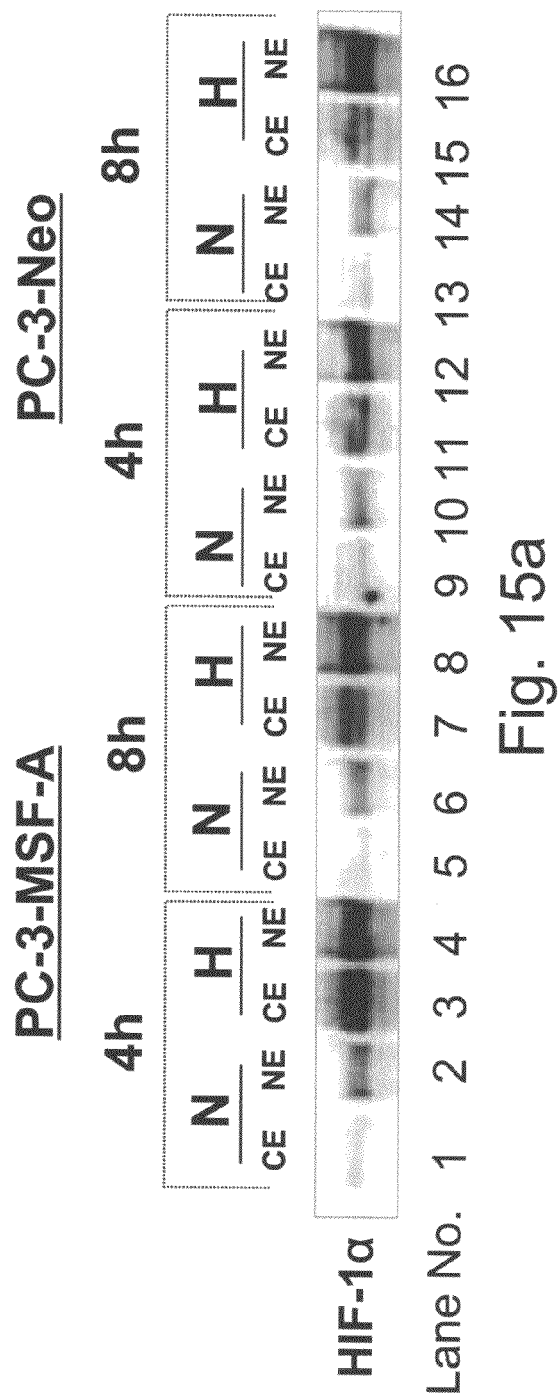
Figure 15B:
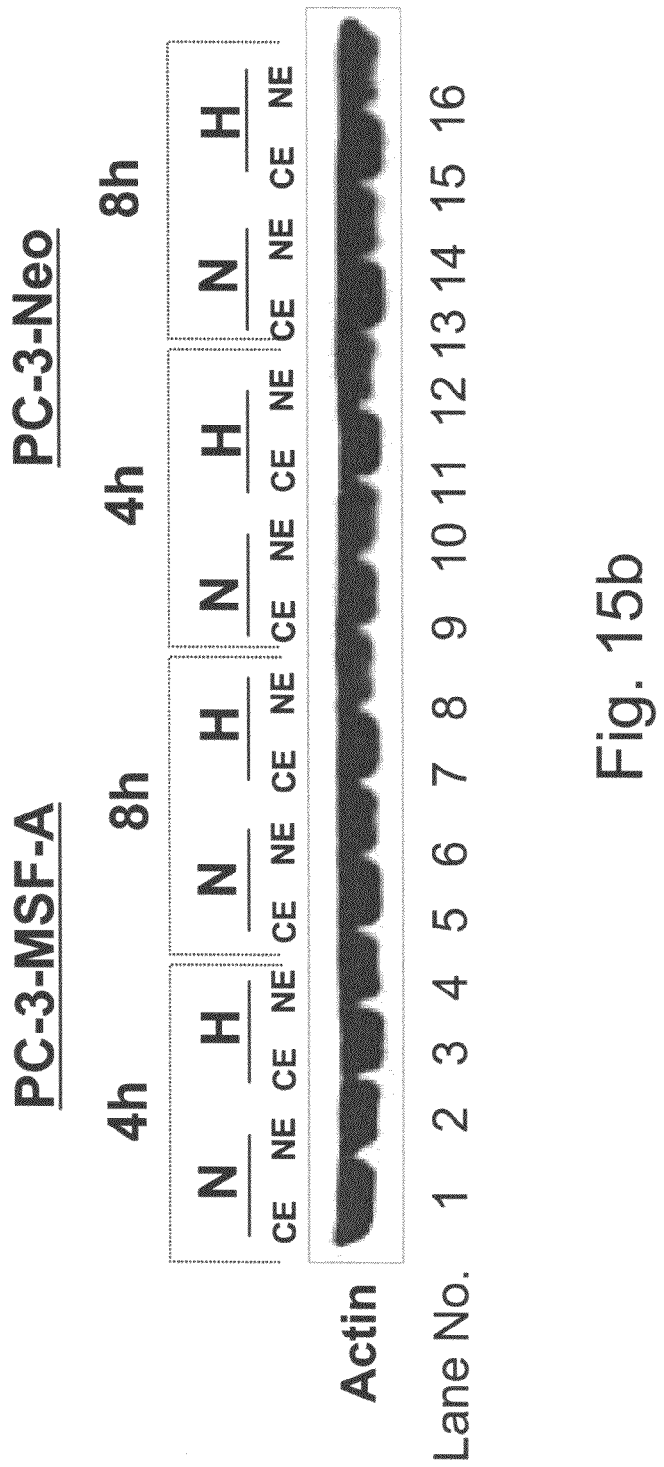

FIGS. 15a-b are Western blot analyses depicting HIF-1α (FIG. 15a) and actin (FIG. 15b) expression level in PC-3-Neo and PC-3-MSF-A cells grown under normoxia (N) or subjected to hypoxia (H). PC-3-Neo cells (lanes 9-16) or PC-3-MSF-A cells (lanes 1-8) were grown under normoxia (lanes 1-2, 5-6, 9-10, 13-14) or hypoxia (lanes 2-4, 7-8, 11-12, 15-16) for 4 hours (lanes 1-4 and 9-12) or 8 hours (lanes 5-6 and 13-16) as indicated. Cytosolic (CE; lanes 1, 3, 5, 7, 9, 11, 13, and 15) or nuclear (NE; lanes 2, 4, 6, 8, 10, 12, 14, and 16) extracts were prepared, analyzed by SDS-PAGE, and immunoblotted with antibodies to HIF-1α and actin.

Figure 16A:
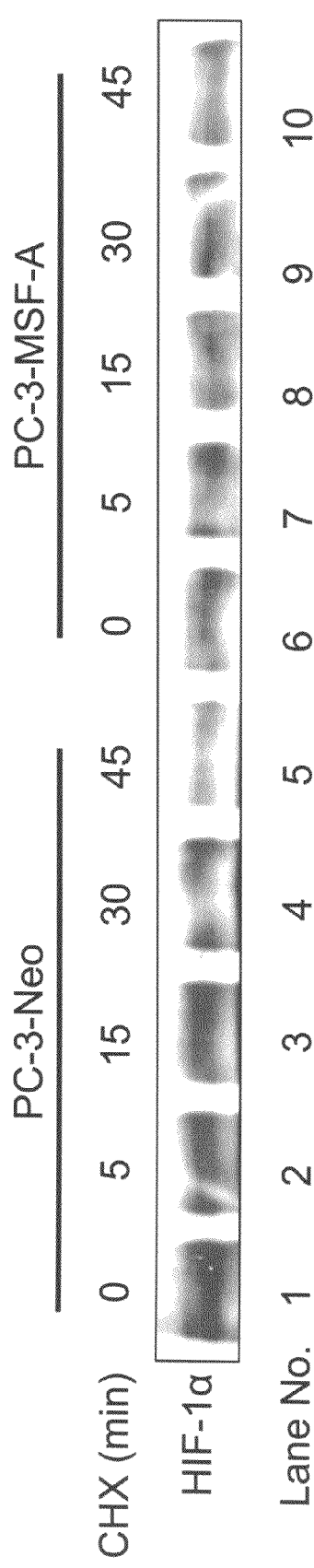
Figure 16B:
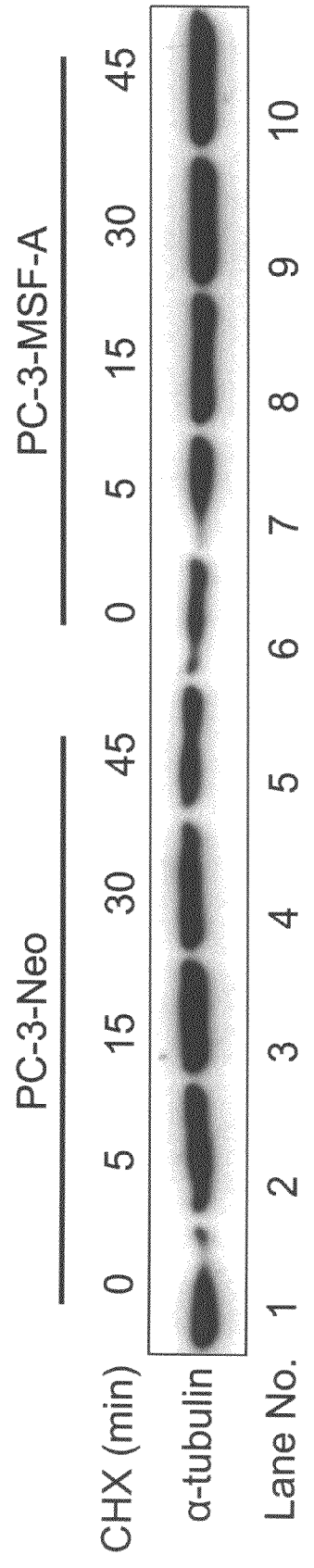
Figure 16C:
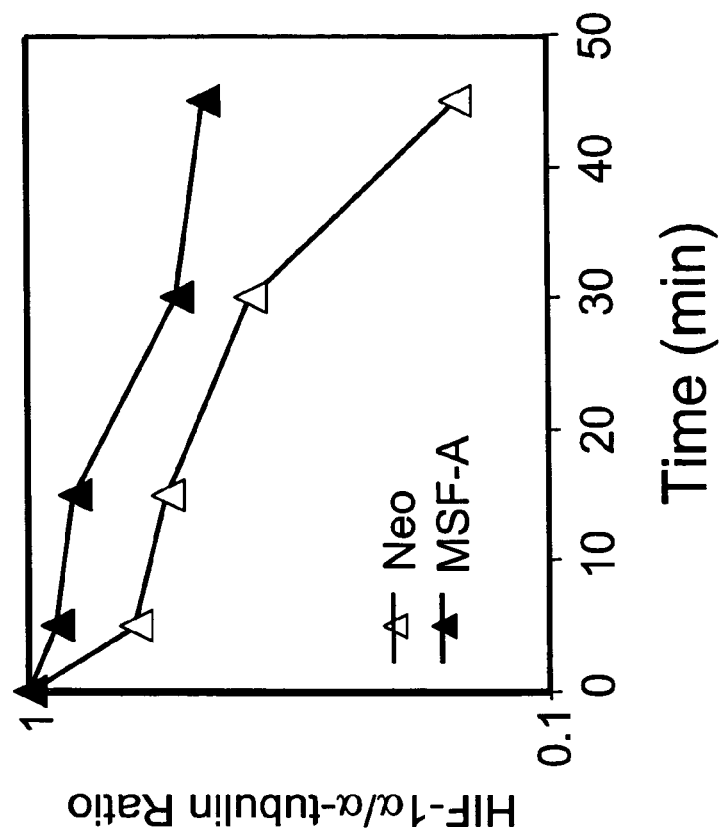

FIGS. 16a-c are Western blot analyses depicting the effect of cycloheximide (CHX) on the expression level of HIF-1α (FIG. 16a) and α-tubulin (FIG. 16b) in PC-3-Neo or PC-3-MSF-A cells grown under normoxia. CHX was added to PC-3-Neo (lanes 1-5) or PC-3-MSF-A (lanes 6-10) at a final concentration of 10 μg/ml, for 0 (lanes 1 and 6), 5 (lanes 2 and 7), 15 (lanes 3 and 8), 30 (lanes 4 and 9) and 45 (lanes 5 and 10) minutes. Whole cell extracts were prepared and resolved by SDS-PAGE and Western blotting was performed with antibodies against HIF-1α (FIG. 16a) or α-tubulin (FIG. 16b). FIG. 16c is a graph depicting quantitation of the results obtained in FIGS. 16a and b expressed as the ratio of HIF-1α expression level normalized to that of α-tubulin. Note, the relatively slow degradation of HIF-1α in cells over-expressing the MSF-A protein, with a degradation half-life of 40 minutes as compared to the degradation half-life of less than 20 minutes in PC-3-Neo cells (FIG. 16c).

FIGS. 17a-b depict pulse-chase analysis of HIF-1α. PC-3-Neo and PC-3-MSF-A cells were labeled with $^{35}$S-methionine and pulse-chased in complete medium containing for the indicated time in hours (h). FIG. 17a—equal amounts of protein from each cell lysate were subjected to immunoprecipitation with anti-HIF-1α antibody, resolved by SDS-PAGE and subjected to autoradiography. FIG. 17b-quantification of the autoradiographic HIF-1α signal by densitometry. Note, the relatively slower degradation of HIF-1α in cells over-expressing the MSF-A protein, with a degradation half-life of 45 minutes as compared to the degradation half-life of 25 minutes in PC-3-Neo cells.

FIGS. 18a-b depict stabilization of HIF-1α in PC-3-MSF-A stably transfected cells. Whole cell lysates from single clones of stably transfected PC-3 cells (expressing different amounts of Flag-MSF-A protein) were grown under normoxia (lanes 1-6) or hypoxia (lanes 7-12) were analyzed on SDS-PAGE and immunoblotted with HIF-1α (FIG. 18a) and Flag (FIG. 18b) antibodies. Note the significant reduction (under hypoxia conditions) in the ubiquitinated species of HIF-1α in MSF-A stably transfected cells (clones 1-5; lanes 8-10 and 12 in FIG. 18a) as compared to cells transfected with the expression vector alone (Neo; lane 7 in FIG. 18a). Also note the correlation between the level of MSF-A expression and the inverse effect on HIF-1α ubiquitinated species (compare e.g., lane 11 to 8 in FIGS. 18a and b).

Figure 19A:
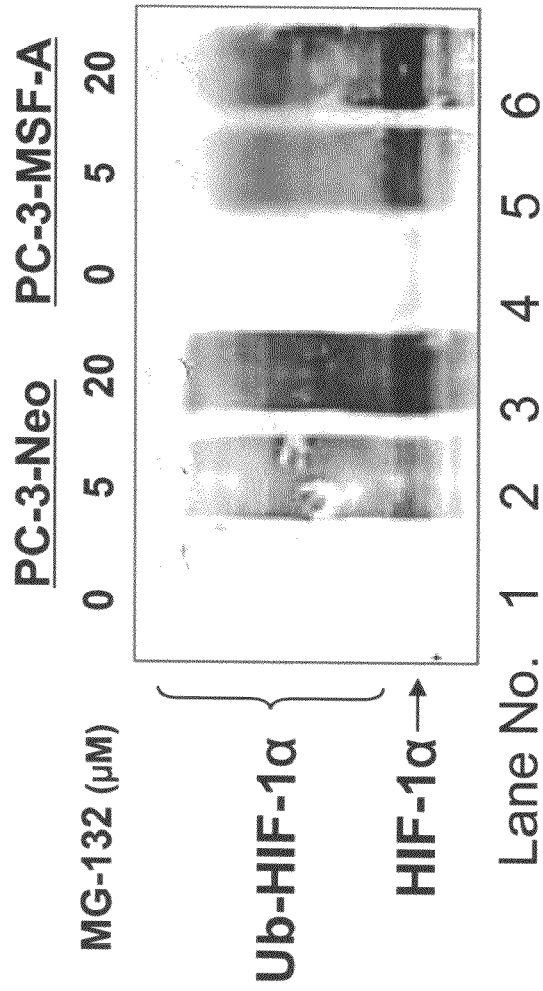
Figure 19B:
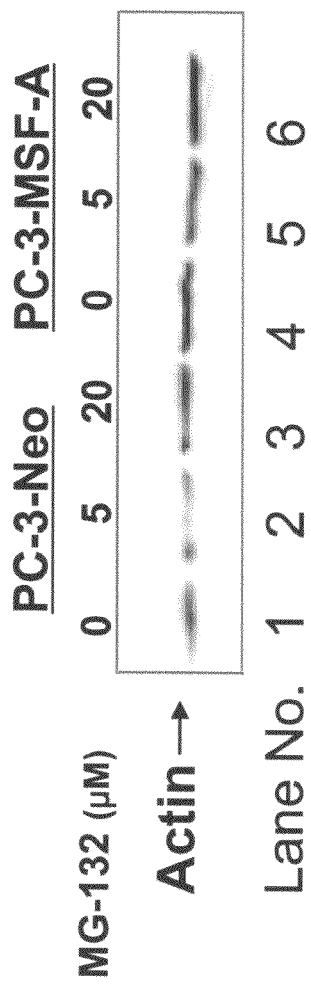

FIGS. 19a-b are Western blot analyses depicting the effect of proteasome inhibition on HIF-1α (FIG. 19a) or actin (FIG. 19b) expression levels in PC-3-MSF-A or PC-3-Neo cells. PC-3-Neo (lanes 1-3) and PC-3-MSF-A (lanes 4-6) cells were treated for 4 hours with either 0.1 DMSO (lanes 1 and 4) or with 5 (lanes 2 and 5) and 20 (lanes 3 and 6) μM MG-132. Whole cell lysates were prepared and equal amounts of protein from each cell lysate were resolved by SDS-PAGE, transferred and immunoblotted with antibodies against HIF-1α (FIG. 19a) and actin (FIG. 19b). Ub-HIF-1α points to ubiquitinated HIF-1α protein species.

Figure 20A:
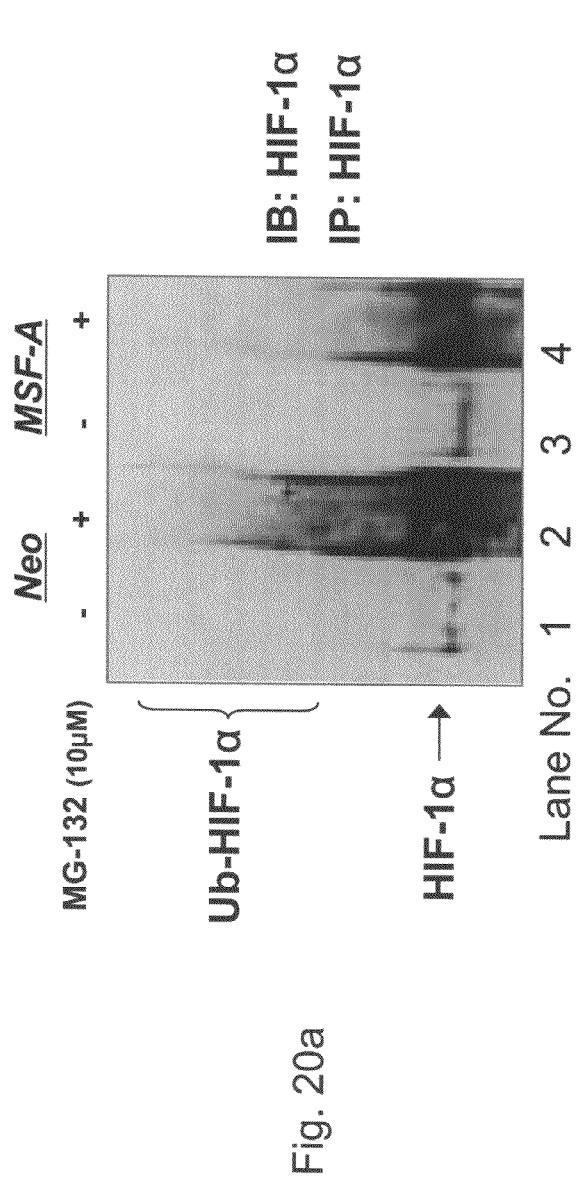
Figure 20B:
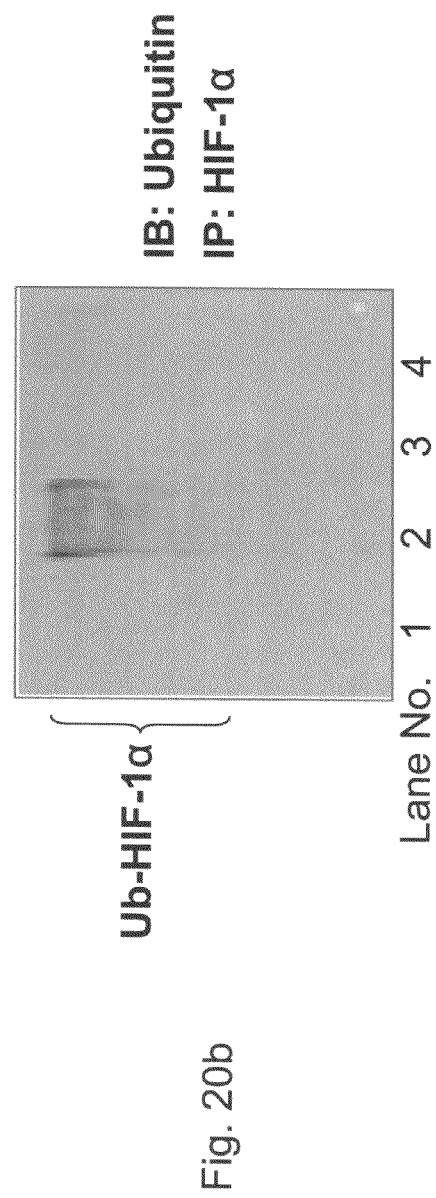

FIGS. 20a-b are Western blot analyses of HIF-1α immunoprecipitates depicting the expression level of HIF-1α (FIG. 20a) and ubiquitin (FIG. 20b) in PC-3-Neo and PC-3-MSF-A cells. PC-3-Neo (lanes 1-2) and PC-3-MSF-A (lanes 3-4) cells were treated for 4 hours with either 0.1 DMSO (lanes 1 and 3) or with 10 μM MG-132 (lanes 2 and 4). Whole cell lysates were prepared and subjected to immunoprecipitation (IP) with HIF-1α antibody. Immunoprecipitates were resolved on SDS-PAGE and immunoblotted (IB) with HIF-1α (FIG. 20a) and ubiquitin (FIG. 20b) antibodies. Ub-HIF-1α points to ubiquitinated HIF-1α protein species.

Figure 21A:
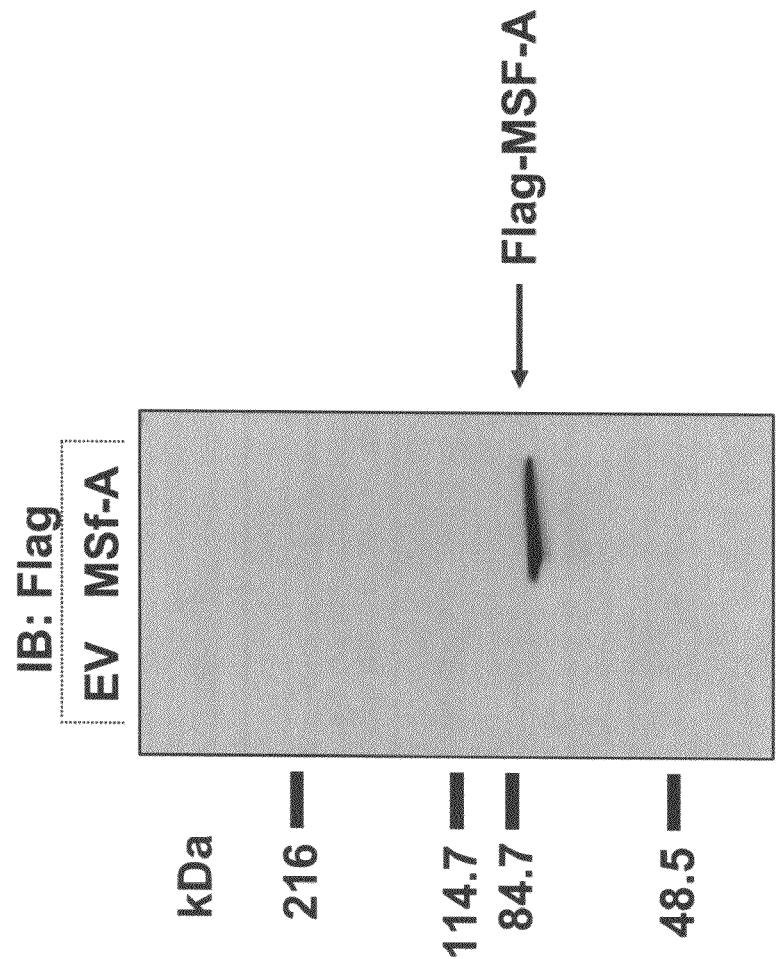
Figure 21B:
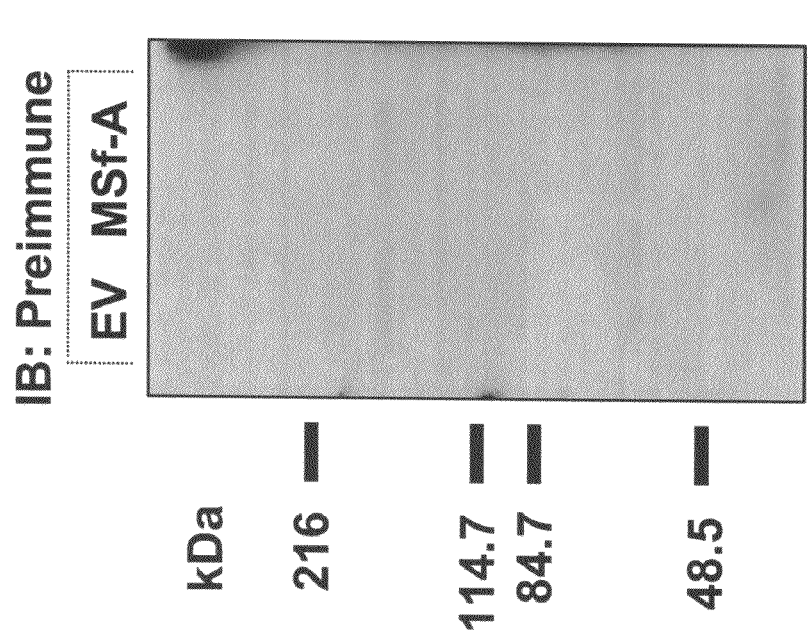
Figure 21C:
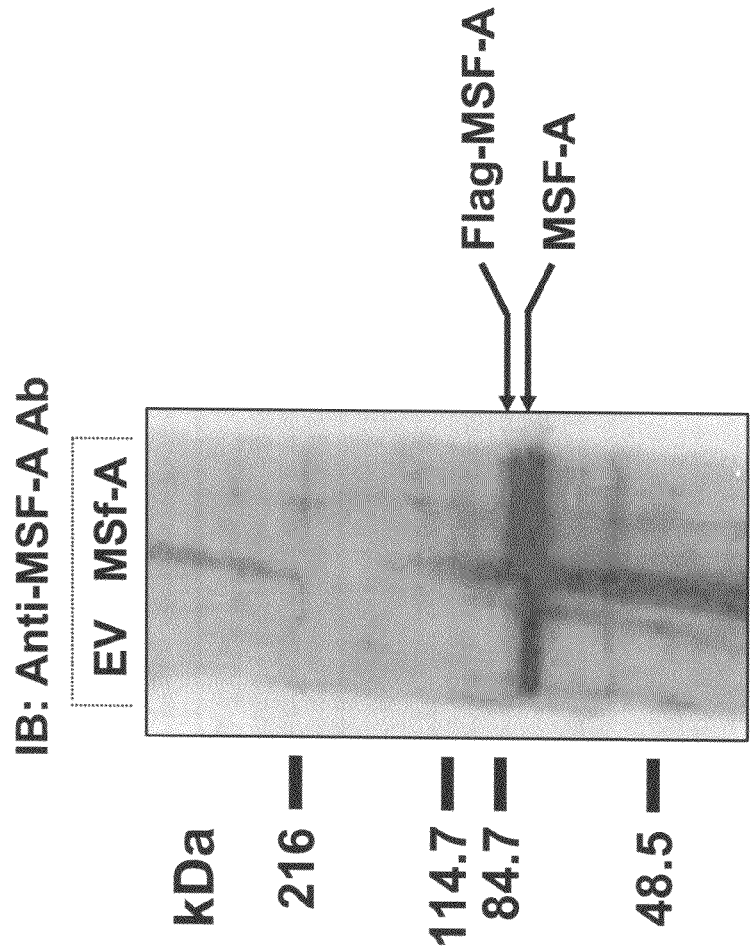

FIGS. 21a-c are Western Blot analyses illustrating the specificity of the anti-MSF-A immune serum. PC-3 cells were transfected with either the expression vector (EV) or the p3xFlag-MSF-A vector (MSF-A) and were subjected to Western Blot analyses (IB) using the anti-Flag antibody (FIG. 21a), preimmune serum (FIG. 21b) or serum after immunization with a peptide corresponding to the N-terminal of MSF-A protein (FIG. 21c). Note the presence of two MSF-A positive bands in PC-3 cells transfected with the p3xFlag-MSF-A vector, corresponding to the Flag—and endogenous MSF-A proteins (FIG. 21c).

Figure 22A:
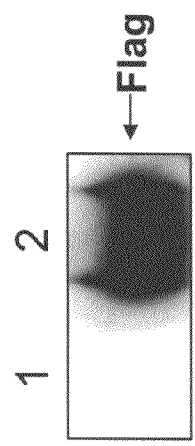
Figure 22B:
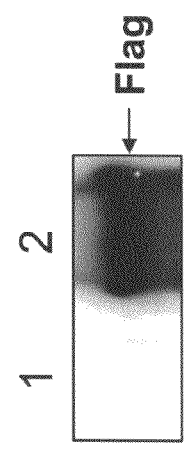
Figure 22C:
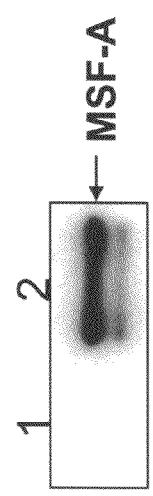
Figure 22D:
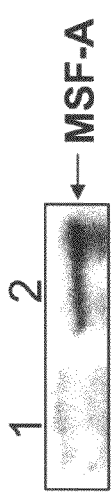

FIGS. 22a-d FLAG (FIGS. 22a-b) or sera-raised MSF-A (FIGS. 22c-d) immunoblot analyses of FLAG IP (FIGS. 22a and c) or whole cell extracts (FIGS. 22b and d). HEK 293 were transfected with expression vector encoding Flag-MSF-A (lane 2) or empty vector (EV, lane 1) and whole cell extracts were prepared. Lysates were subjected to immunoprecipitation (IP) with Flag antibody. Immunoprecipitates were resolved on SDS-PAGE and analyzed by immunoblotting (IB) with Flag antibody or sera raised against the N-terminus of MSF-A. FIG. 22a—IP with FLAG and IB with FLAG; FIG. 22b—no IP and IB with FLAG; FIG. 22c—IP with FLAG and IB with sera-raised MSF-A; FIG. 22d—no IP and IB with the sera-raised MSF-A.

FIGS. 23a-c are Western blot analyses depicting the expression of HIF-1α (FIG. 23a) and MSF-A (FIG. 23b) in the nuclear rather than the cytosolic cell fraction. PC-3 or CL-1 cells were grown for 24 hours under either normoxia or hypoxia following which the expression level of HIF-1α (FIG. 23a), MSF-A (FIG. 23b) or α-tubulin (FIG. 23c) was detected using Western blot analysis. CE=cytosolic extract; NE=nuclear extract; N=normoxia; H=hypoxia. Note that while MSF-A and HIF-1α localize at the cell nuclear fraction, the α-tubulin protein localizes at both the nuclear and cytoplasm fractions.

FIGS. 24a-d illustrate MSF-A immunofluorescence staining in PC-3 cells using MSF-A preimmune (FIGS. 24c-d) or immune sera (FIGS. 24e-f) under normoxia (FIGS. 24c and e) or hypoxia (FIGS. 24d and f).

FIGS. 25a-f illustrate HIF-1α and MSF-A co-localization in PC-3 cells using anti-HIF-1α (FIGS. 25a-b), anti-MSF-A (FIGS. 25c-d) or both antibodies (FIGS. 25e-f) under normoxia (FIGS. 25a, c, e) or hypoxia (FIGS. 25b, d, f).

Figure 26A:
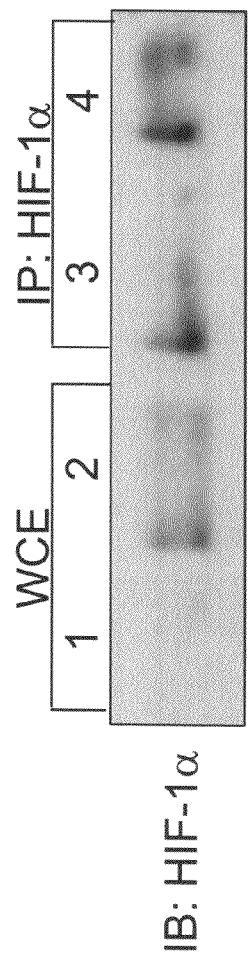
Figure 26B:
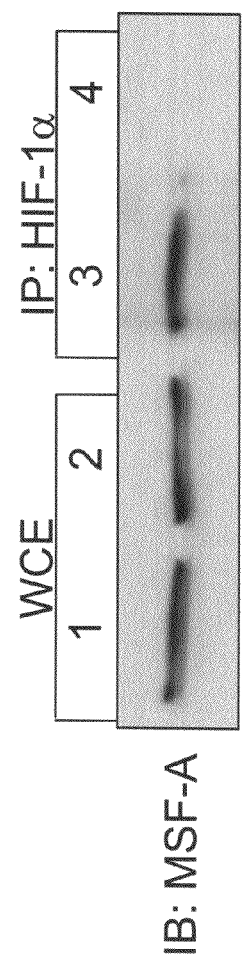
Figure 26C:
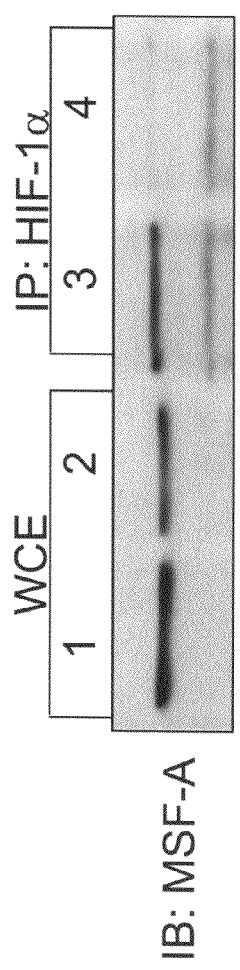

FIGS. 26a-c are Western Blot analyses of whole cell extracts (WCE) or HIF-1α-IP using anti-HIF-1α (FIG. 26a) or anti-MSF-A (FIGS. 26b-c) antibodies. PC-3 (FIGS. 26a-b) or CL-1 (FIG. 26c) cells were grown under normoxia or hypoxia and whole cell extracts or HIF-1α-immunoprecipitates were subjected to Western Blot analyses. Lanes 1 and 3-normoxia; lanes 2 and 4-hypoxia.

Figure 27:
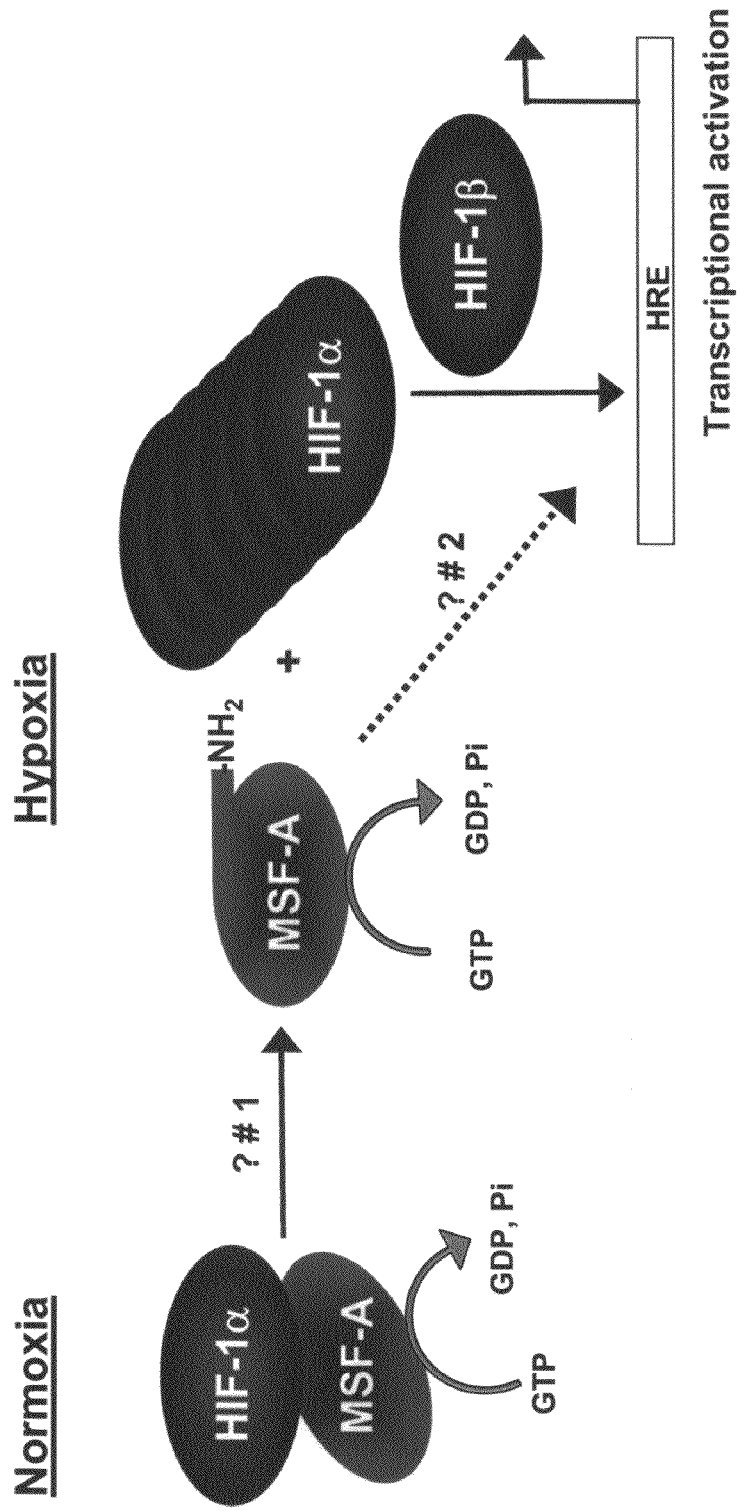

FIG. 27 is a schematic presentation depicting MSF-A involvement in the regulation of HIF.

Figure 28:
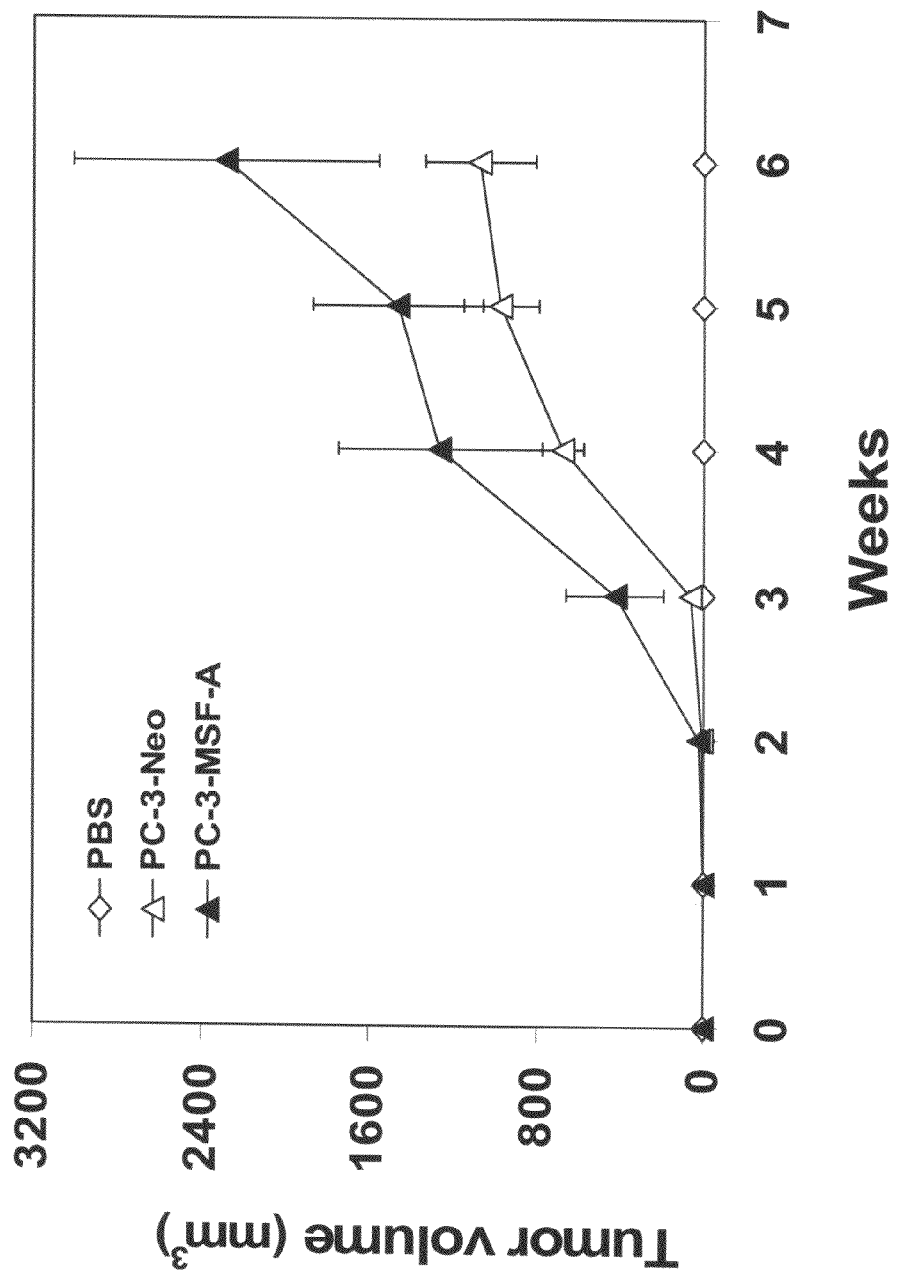

FIG. 28 is a graph depicting the effect of MSF-A over-expression on tumor volume. A prostate cancer xenograft model was established using PC-3-Neo and PC-3-MSF-A cells ($3 \times 10^6$) which were implanted subcutaneously into the right hind of nude mice. PBS was used as a negative control. Animals were monitored for tumor volume measurements. Tumor volume measurements were calculated using the formula width$^2 \times$length$\times 0.52$. Mean±SEM (n=5) of representative experiments is shown. Note the significant increase in tumor volume in xenografts injected with cells over-expressing the MSF-A protein (PC-3-MSF-A).

Figure 29:
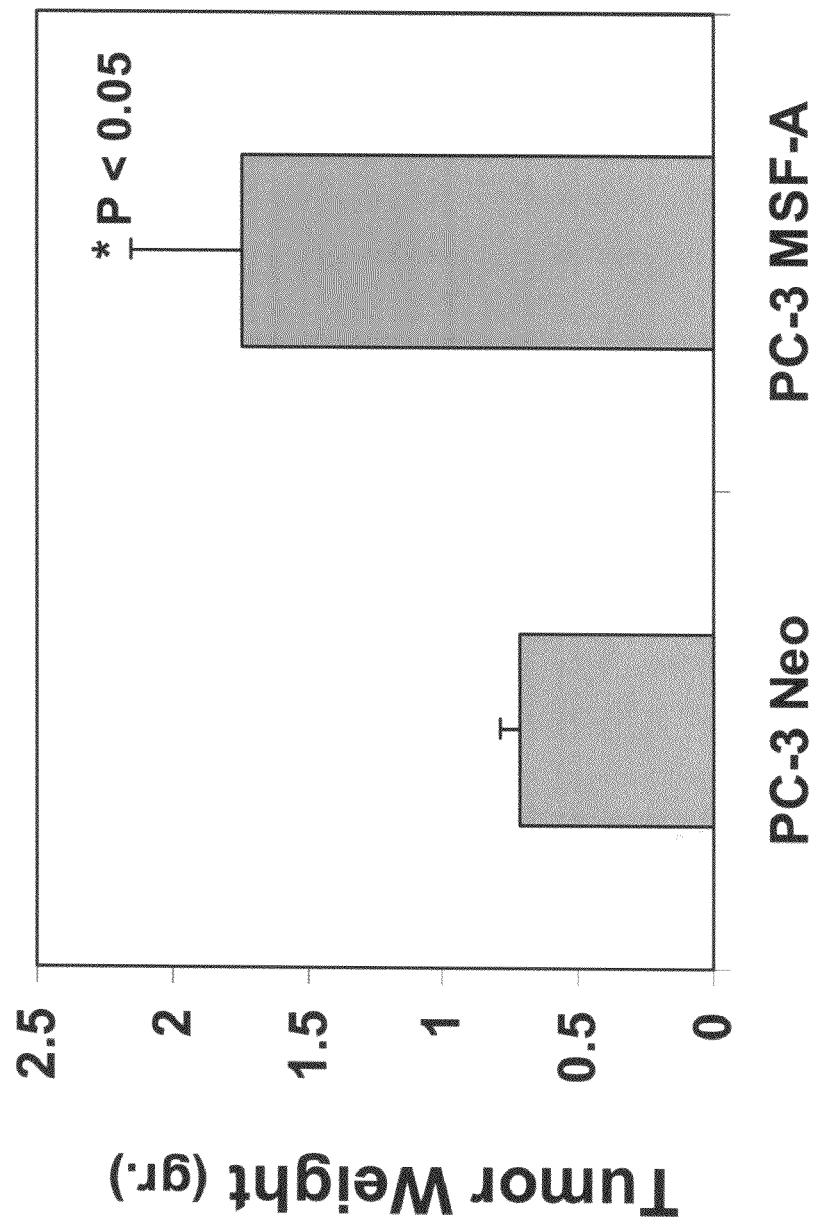

FIG. 29 is a graph depicting the effect of MSF-A over-expression on tumor weight. A prostate cancer xenograft model was established as described in FIG. 28. Mice were sacrificed after 6 weeks and tumors were processed for tumor weight measurements. Tumors were weighed immediately after dissection. Columns, means; bars, SEM; n=5; *, $p<0.05$. Note the significant increase in tumor weight in xenografts injected with cells over-expressing the MSF-A protein (PC-3-MSF-A).

Figure 30G:
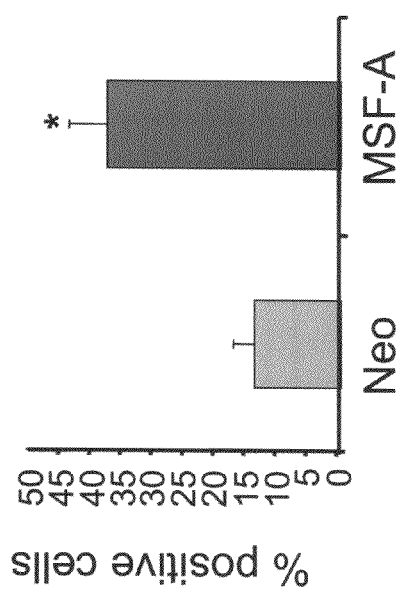
Figure 30H:
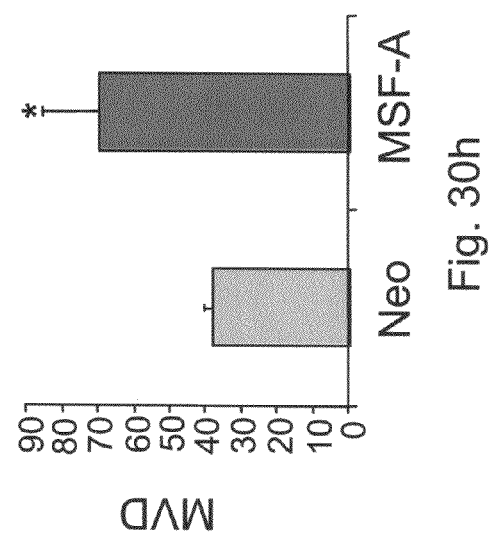

FIGS. 30a-h are photomicrographs (FIGS. 30a-f) and graphs (FIGS. 30g-h) depicting MSF-A over-expression in tumors and angiogenesis in a prostate cancer xenograft model. Sections from both PC-3-Neo (FIGS. 30a, c, and e) and PC-3-MSF-A (FIGS. 30b, d, and f) tumors were subjected for Hematoxylin-eosin (H& E; FIGS. 30a-b) and immunostaining with Ki67 (FIGS. 30c and d) and CD34 (FIGS. 30e and f). FIG. 30g—Ki67 staining (%) was quantified by dividing the number of positive nuclei by the number of total nuclei in 40× magnification field multiplied by 100, of 5 paraffin-embedded tumor sections from each animal per group. Columns, average of the means of Ki67 staining from each animal; bars, SEM; n=5; *, $p<0.05$. FIG. 30h—Microvessel density (MVD) was determined by counting the capillaries positive for CD34 staining in 4× magnification field per total section area excluding necrotic areas in 5 paraffin-embedded tumor sections from each animal per group. Columns, average of the means of MVD from each animal; bars, SEM; n=5; *, $p<0.05$.

FIGS. 31a-f are RT-PCR analyses of MSF-A (FIG. 31a), VEGF (FIG. 31b), CA-IX (FIG. 31c), Glut-1 (FIG. 31d), ET-1 (FIG. 31e) and β-actin (FIG. 31f) of RNA isolated from either PC-3-Neo (lane 1) or PC-3-MSF-A (lane 2)-derived tumors. Lane 3=water (negative control).

Figure 32A:
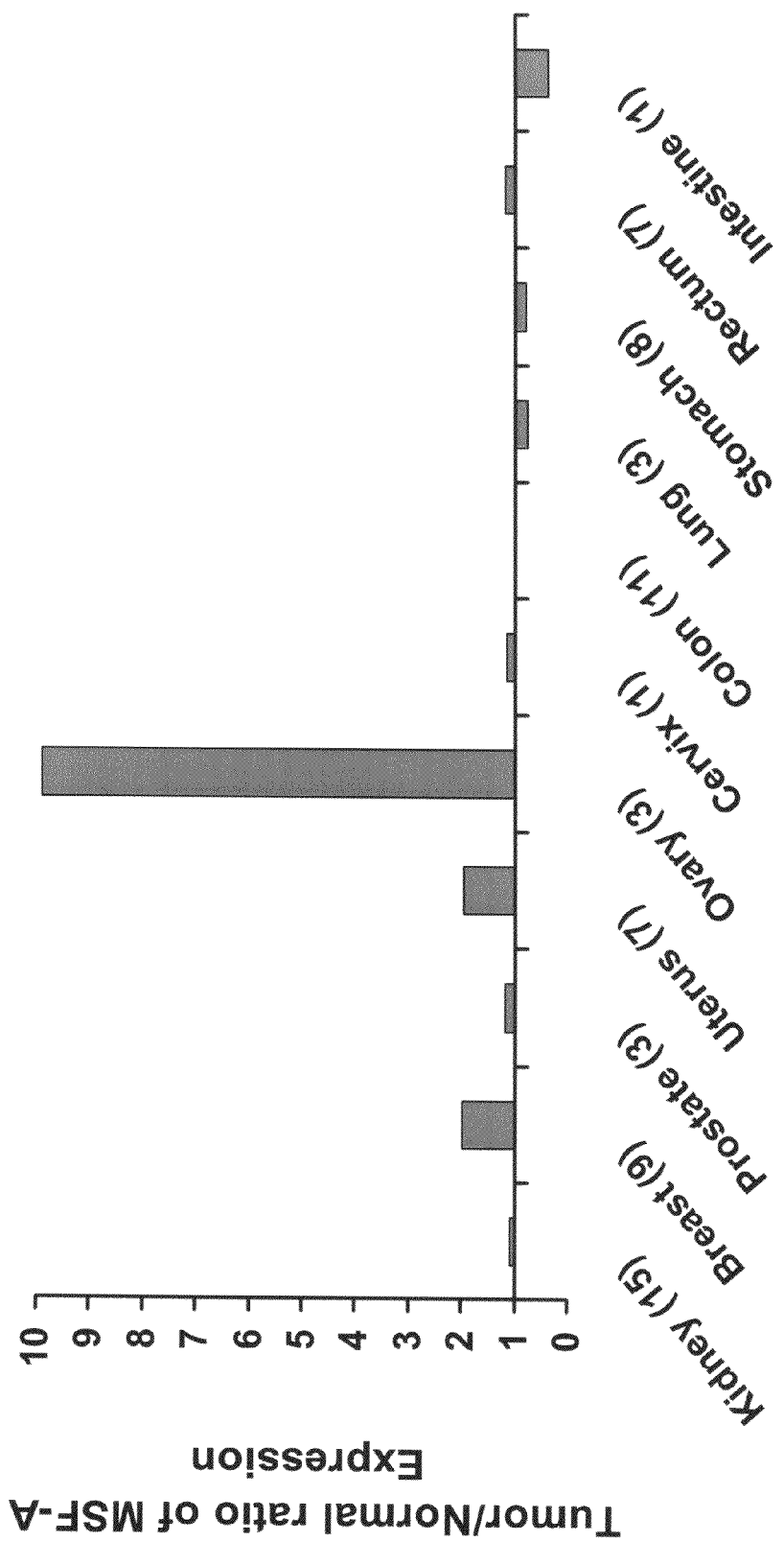
Figure 32B:
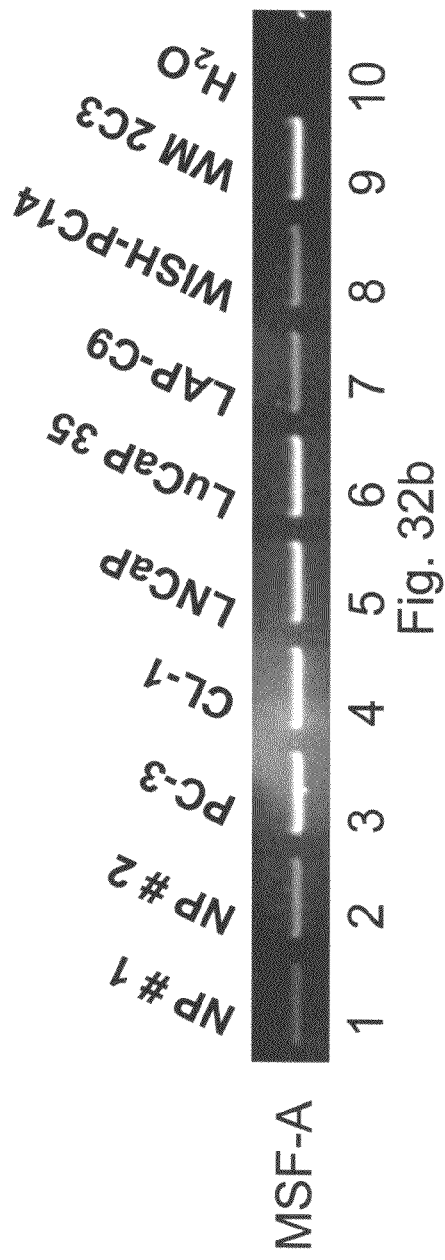
Figure 32C:
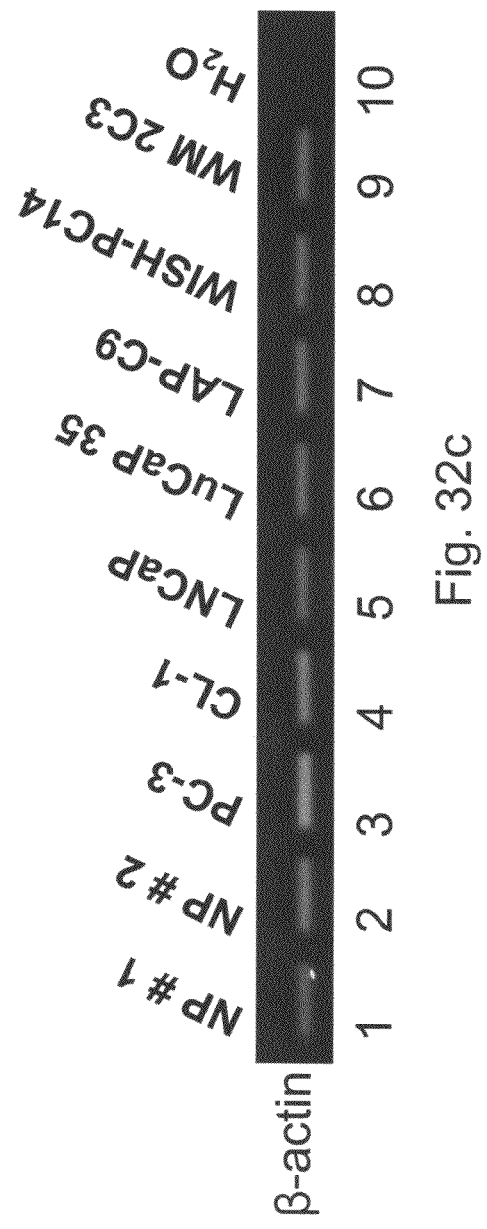
Figure 32D:
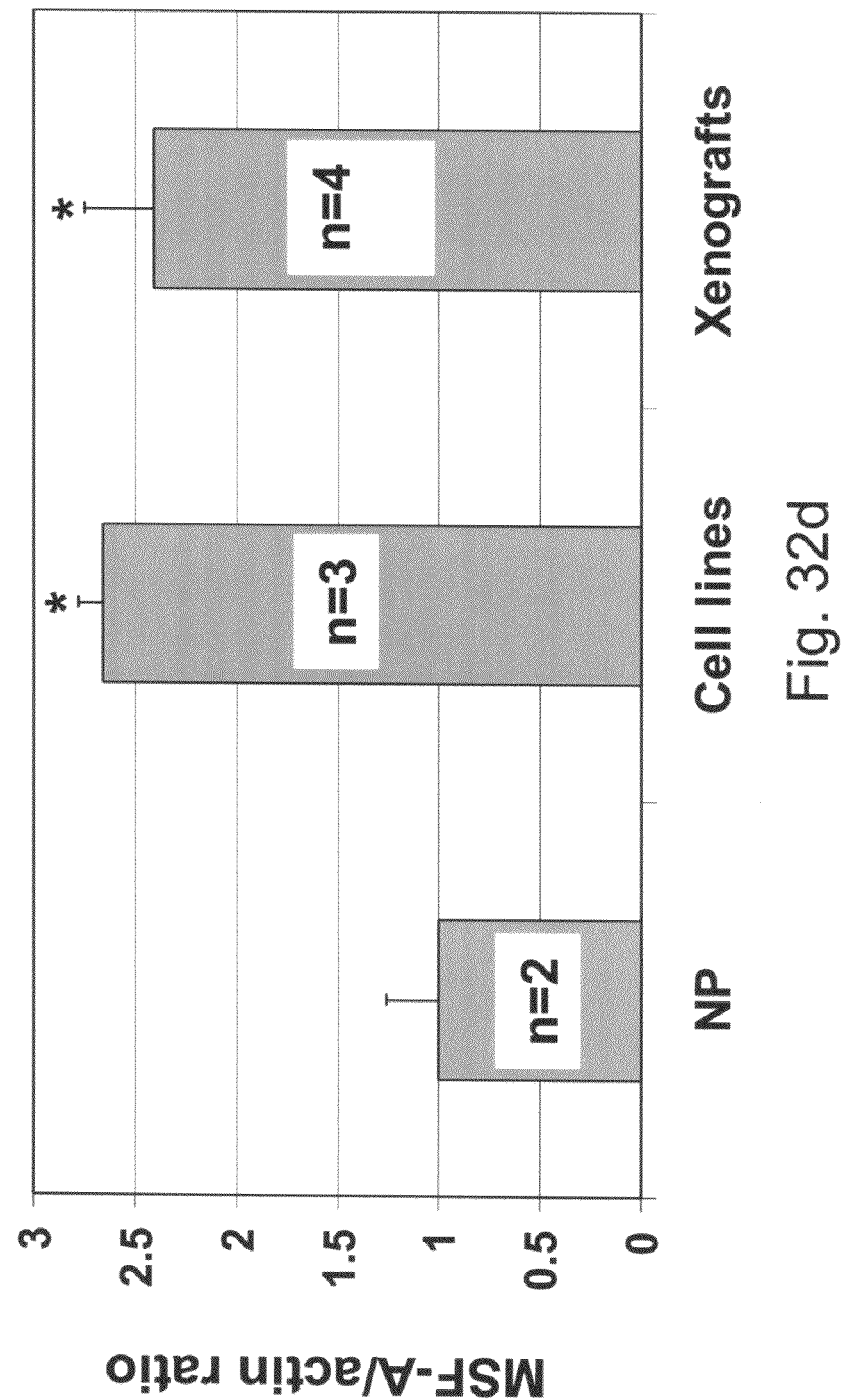

FIGS. 32a-d depict MSF-A mRNA expression in human tumors. FIG. 32a is a graph depicting normalized MSF-A expression levels in various tumors. Human Matched Tumor/Normal Expression Array (containing 68 pairs of tumor/normal different tissues) was hybridized with probe to MSF-A (SEQ ID NO:4214, the probe also reacts with other SEPT9 transcripts) and to β-actin (Ambion). Autoradiograms were analyzed, and the expression ratio of each tumor/normal was depicted in the graph. Numbers in parenthesis point to the number of pairs of each tumor type. FIGS. 32b-c are RT-PCR analyses of MSF-A (FIG. 32b) and β-actin (FIG. 32c) in various normal and cancerous tissues or cells. Total RNA was isolated from two different normal prostate tissues [NP, NP#1 (lane 1), NP#2 (lane 2)], prostate cancer cell lines [PC-3 (lane 3), CL-1 (lane 4), LNCaP (lane 5)] and prostate cancer xenografts [LuCaP 35 (lane 6), LAP-C9 (lane 7), WISH-PC-14 (lane 8), WM 2C3 (lane 9)], and was analyzed by RT-PCR using primers specific to MSF-A (SEQ ID NOs:4 and 4199) and β-actin (SEQ ID NOs:4202-4205). FIG. 32d is a graph depicting normalization of the RT-PCR analyses shown in FIGS. 32b and c. Shown are the average densitometric quantification of MSF-A/actin expression in the normal prostate tissues (NP), the prostate cancer cell lines and xenografts.

DESCRIPTION OF THE PREFERRED EMBODIMENTS

The present invention is of agents capable of preventing the formation of, and/or dissociating an MSF-A-HIF-1α protein complex or of agents capable of stabilizing the MSF-A-HIF-1α protein complex which can be used to treat cancer or acute ischemia, respectively. Specifically, the present invention can be used to treat individuals having cancer using agents capable of downregulating the MSF-A and/or HIF-1α proteins.

The principles and operation of the methods of treating cancer or acute ischemia according to the present invention may be better understood with reference to the drawings and accompanying descriptions.

Before explaining at least one embodiment of the invention in detail, it is to be understood that the invention is not limited in its application to the details set forth in the following description or exemplified by the Examples. The invention is capable of other embodiments or of being practiced or carried out in various ways. Also, it is to be understood that the phraseology and terminology employed herein is for the purpose of description and should not be regarded as limiting.

Over-expression of HIF-1α is found in the majority of solid tumors and cancer metastases in the areas of profound hypoxia [Quintero, 2004 (Supra)]. In addition, in many cases, the major reason for the failure of anti cancer therapy is the resistance of hypoxic cancer cells to both chemotherapy and radiation [Escuin, 2004 (Supra)]. Thus, HIF-1α has been recognized as a possible target for anti cancer therapy [Welsh, 2003 (Supra)].

Several agents capable of downregulating HIF-1 have been identified as potential anti-cancer agents including FK228, a histone deacetylase (HDAC) inhibitor [Mie Lee, 2003 (Supra)], PX-478, a small-molecule HIF-1 inhibitor, [Macpherson, 2004 (Supra)] and Bisphenol A, an environmental endocrine-disrupting chemical [Kubo, 2004 (Supra)]. However, the mechanisms leading to up- or down-regulation of HIFs in cancerous tumors are not yet clear, thus, limiting the use of HIF-1 inhibitors/suppressors as anti cancer agents.

While reducing the present invention to practice, the present inventor has uncovered that MSF-A, a myeloid/lymphoid leukemia septin-like fusion protein A, associates with HIF-1α both in vitro and in vivo (Example 1, FIGS. 1-5) and that MSF-A over-expression upregulates HIF-1α transcriptional activity (Example 2, FIG. 6). When in a complex with HIF-1α, MSF-A prevents proteasomal degradation of HIF-1α (Example 5, FIGS. 15-20). Moreover, as is further shown in FIGS. 28-32 and is described in Examples 8 and 9 of the Examples section which follows, MSF-A is over-expressed in various tumors and is capable of inducing tumor growth, angiogenesis and proliferation in vivo. These findings have led the present inventor to design agents which can be used to treat cancer by downregulating MSF-A dependent HIF-1α activity.

As described in Example 3 of the Examples section which follows, transfection of cells with the p3xFlag-ΔN-MSF-A expression vector encoding an N-terminal truncated form of the MSF-A protein resulted in inhibition of HIF-1α activation below the level observed in cells transfected with the empty vector (i.e., wild type, FIG. 7). In addition, transfection of cells with the p3xFlag-ΔG-MSF (lacking the GTP binding domain of MSF-A) resulted in lack of activation of HIF-1α transcriptional activity (levels of activation were similar to those observed with the empty vector, FIG. 8). On the other hand, as is shown in FIGS. 9a-c, both of these mutants (i.e., ΔG-MSF and ΔN-MSF) were co-immunoprecipitated with the HIF-1α protein demonstrating their ability to interfere with HIF-1α activity via the formation of the protein complex between HIF-1α and MSF-A.

Thus, according to one aspect of the present invention there is provided a method of treating cancer and/or inhibiting a growth of a cancerous tumor and/or metastases in an individual. The method is effected by providing to the individual an agent capable of downregulating an MSF-A-dependent HIF-1α activity in cells of the individual thereby treating the cancer and/or inhibiting the growth of the cancerous tumor and/or the metastases in the individual.

As used herein, the term "individual" includes mammals, preferably human beings at any age. Preferably, this term encompasses individuals which have been diagnosed with cancer, i.e., they have cancerous cells, a cancerous tumor and/or cancer metastases.

The phrase "treating" refers to inhibiting or arresting the development of a disease, and/or causing the reduction, remission, or regression of a disease, in an individual suffering from, or diagnosed with, the disease. Those of skill in the art will be aware of various methodologies and assays which can be used to assess the development of a disease, and similarly, various methodologies and assays which can be used to assess the reduction, remission or regression of a disease.

The terms "cancer" and/or "cancerous tumor" as used herein encompass solid and non-solid tumors such as prostate cancer, breast cancer, chemotherapy-induced MLL, stomach cancer, cervical cancer, endometrial cancer, ovarian cancer and the like.

As used herein the term "HIF-1α" refers to the hypoxia-inducible factor 1, alpha subunit isoform 1 (SEQ ID NO:11; GenBank Accession No. AAP88778), which is a member of the Per-ARNT-Sim (PAS) superfamily 1 and an aryl hydrocarbon receptor nuclear translocator (ARNT) interacting protein.

The phrase "MSF-A-dependent HIF-1α activity" as used herein, refers to HIF-1α protein activity (e.g., transcriptional activation of genes such as VEGF) which is dependent on the direct or indirect interaction with MSF-A, and/or on the activation, stabilization and/or prevention of degradation which is mediated by MSF-A.

As used herein the term "MSF-A: refers to the myeloid/lymphoid leukemia septin-like fusion protein A (MSF-A, GenBank Accession No. AAF23374, SEQ ID NO:3).

Downregulating an MSF-A-dependent HIF-1α activity can be effected by various approaches including, for example, directly or indirectly interfering with MSF-A dependent HIF-1α protein stabilization, promoting MSF-A dependent HIF-1α protein degradation and/or preventing the formation of MSF-A-HIF-1α complex or dissociating a pre-existing MSF-A-HIF-1α complex.

It will be appreciated that several approaches can be used to prevent the formation of and/or dissociate the MSF-A-HIF-1α protein complex in cells. These include downregulation of the expression level and/or activity of any of the proteins in the protein complex (i.e., MSF-A and/or HIF-1α) and thus preventing MSF-A-HIF-1α complex formation, interference with the protein complex or destabilization thereof.

Downregulation of MSF-A and/or HIF-1α can be effected on the genomic and/or the transcript level using a variety of molecules which interfere with transcription and/or translation (e.g., antisense, siRNA, Ribozyme, DNAzyme), or on the protein level using e.g., antagonists, antibodies, enzymes that cleave the polypeptide and the like. Preferably, agents which are capable of preventing the association between HIF-1α and MSF-A are suitable for use along with the present invention.

Following is a list of agents capable of downregulating expression level and/or activity of MSF-A or HIF-1α and as such are suitable for use with the method of the present invention.

One example of an agent capable of downregulating MSF-A-dependent HIF-1α activity, preventing the formation of an MSF-A-HIF-1α complex or destabilizing an already formed complex is an antibody or antibody fragment capable of specifically binding MSF-A or HIF-1α. Such an antibody can be a neutralizing antibody which binds an epitope on MSF of HIF-1α and thus inhibits MSF-A-dependent HIF-1α activity. Preferably, the antibody specifically binds at least one epitope of a MSF-A or HIF-1α. Non-limiting examples of such epitopes are set forth by SEQ ID NO:4213 or 4198. Measures are taken though, to select an epitope which will be specifically recognized by the neutralizing antibody. For example, a suitable antibody which can be used along with the present invention is an anti-MSF-A antibody or antibody fragment as described in Example 6 of the Examples section which follows, which is capable of specifically binding to the polypeptide set forth by SEQ ID NO:3.

As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three-dimensional structural characteristics, as well as specific charge characteristics.

The term "antibody" as used in this invention includes intact molecules as well as functional fragments thereof, such as Fab, F(ab')2, and Fv that are capable of binding to macrophages. These functional antibody fragments are defined as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')2, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference and the Material and Experimental Methods section of Example 3 in the Examples section which follows).

Antibody fragments according to the present invention can be prepared by proteolytic hydrolysis of the antibody or by expression in *E. coli* or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (19720]. Alternatively, the variable chains can be linked by an intermolecular disulfide bond or cross-linked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as *E. coli*. The recombinant host cells synthesize a single polypeptide chain with a linker peptide bridging the two V domains. Methods for producing sFvs are described, for example, by [Whitlow and Filpula, Methods 2: 97-105 (1991); Bird et al., Science 242:423-426 (1988); Pack et al., Bio/Technology 11:1271-77 (1993); and U.S. Pat. No. 4,946,778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)].

Humanized forms of non-human (e.g., murine) antibodies are chimeric molecules of immunoglobulins, immunoglobulin chains or fragments thereof (such as Fv, Fab, Fab', F(ab') .sub.2 or other antigen-binding subsequences of antibodies) which contain minimal sequence derived from non-human immunoglobulin. Humanized antibodies include human immunoglobulins (recipient antibody) in which residues form a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., Nature, 321:522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature 332:323-327 (1988); Verhoeyen et al., Science, 239:1534-1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boerner et al. are also available for the preparation of human monoclonal antibodies (Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introduction of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545, 807; 5,545,806; 5,569,825; 5,625,126; 5,633,425; 5,661,016, and in the following scientific publications: Marks et al., Bio/Technology 10: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and Lonberg and Huszar, Intern. Rev. Immunol. 13, 65-93 (1995).

It will be appreciated that targeting of particular compartment within the cell can be achieved using intracellular antibodies (also known as "intrabodies"). These are essentially SCA to which intracellular localization signals have been added (e.g., ER, mitochondrial, nuclear, cytoplasmic). This technology has been successfully applied in the art (for review, see Richardson and Marasco, 1995, TIBTECH vol. 13). Intrabodies have been shown to virtually eliminate the expression of otherwise abundant cell surface receptors and to inhibit a protein function within a cell (See, for example, Richardson et al., 1995, Proc. Natl. Acad. Sci. USA 92: 3137-3141; Deshane et al., 1994, Gene Ther. 1: 332-337; Marasco et al., 1998 Human Gene Ther 9: 1627-42; Shaheen et al., 1996 J. Virol. 70: 3392-400; Werge, T. M. et al., 1990, FEBS Letters 274:193-198; Carlson, J. R. 1993 Proc. Natl. Acad. Sci. USA 90:7427-7428; Biocca, S. et al., 1994, Bio/Technology 12: 396-399; Chen, S-Y. et al., 1994, Human Gene Therapy 5:595-601; Duan, L et al., 1994, Proc. Natl. Acad. Sci. USA 91:5075-5079; Chen, S-Y. et al., 1994, Proc. Natl. Acad. Sci. USA 91:5932-5936; Beerli, R. R. et al., 1994, J. Biol. Chem. 269:23931-23936; Mhashilkar, A. M. et al., 1995, EMBO J. 14:1542-1551; PCT Publication No. WO 94/02610 by Marasco et al.; and PCT Publication No. WO 95/03832 by Duan et al.).

To prepare an intracellular antibody expression vector, the cDNA encoding the antibody light and heavy chains specific for the target protein of interest are isolated, typically from a hybridoma that secretes a monoclonal antibody specific for the marker. Hybridomas secreting anti-marker monoclonal antibodies, or recombinant monoclonal antibodies, can be prepared using methods known in the art. Once a monoclonal antibody specific for the marker protein is identified (e.g., either a hybridoma-derived monoclonal antibody or a recombinant antibody from a combinatorial library), DNAs encoding the light and heavy chains of the monoclonal antibody are isolated by standard molecular biology techniques. For hybridoma derived antibodies, light and heavy chain cDNAs can be obtained, for example, by PCR amplification or cDNA library screening. For recombinant antibodies, such as from a phage display library, cDNA encoding the light and heavy chains can be recovered from the display package (e.g., phage) isolated during the library screening process and the nucleotide sequences of antibody light and heavy chain genes are determined. For example, many such sequences are disclosed in Kabat, E. A., et al. (1991) Sequences of Proteins of Immunological Interest, Fifth Edition, U.S. Department of Health and Human Services, NIH Publication No. 91-3242 and in the "Vbase" human germline sequence database. Once obtained, the antibody light and heavy chain sequences are cloned into a recombinant expression vector using standard methods.

As is shown in FIGS. 23-27 and is described in Example 7 of the Examples section which follows, both the MSF-A and HIF-1α are co-localized in the cell nucleus. To direct the specific expression of an antibody to the cell nuclei, a nuclear localization signal coding sequence (e.g., PKKKRKV; Eguchi A, et al., 2005, J. Control Release. 104: 507-19) is preferably ligated to a nucleic acid construct encoding the antibody, preferably, downstream of the coding sequence of the antibody. An intracellular antibody expression vector can encode an intracellular antibody in one of several different forms. For example, in one embodiment, the vector encodes full-length antibody light and heavy chains such that a full-length antibody is expressed intracellularly. In another embodiment, the vector encodes a full-length light chain but only the VH/CH1 region of the heavy chain such that a Fab fragment is expressed intracellularly. In another embodiment, the vector encodes a single chain antibody (scFv) wherein the variable regions of the light and heavy chains are linked by a flexible peptide linker [e.g., $(Gly_4Ser)_3$ and expressed as a single chain molecule. To inhibit marker activity in a cell, the expression vector encoding the intracellular antibody is introduced into the cell by standard transfection methods, as discussed hereinbefore.

Another agent capable of downregulating MSF-A-dependent HIF-α activity, or preventing the formation of an MSF-A-HIF-1α complex is a small interfering RNA (siRNA) molecule which is capable of downregulating expression of MSF-A or HIF-1α. RNA interference is a two step process. The first step, which is termed as the initiation step, input dsRNA is digested into 21-23 nucleotide (nt) small interfering RNAs (siRNA), probably by the action of Dicer, a member of the RNase III family of dsRNA-specific ribonucleases, which processes (cleaves) dsRNA (introduced directly or via a transgene or a virus) in an ATP-dependent manner. Successive cleavage events degrade the RNA to 19-21 bp duplexes (siRNA), each with 2-nucleotide 3' overhangs [Hutvagner and Zamore Curr. Opin. Genetics and Development 12:225-232 (2002); and Bernstein Nature 409:363-366 (2001)].

In the effector step, the siRNA duplexes bind to a nuclease complex to from the RNA-induced silencing complex (RISC). An ATP-dependent unwinding of the siRNA duplex is required for activation of the RISC. The active RISC then targets the homologous transcript by base pairing interactions and cleaves the mRNA into 12 nucleotide fragments from the 3' terminus of the siRNA [Hutvagner and Zamore Curr. Opin. Genetics and Development 12:225-232 (2002); Hammond et al. (2001) Nat. Rev. Gen. 2:110-119 (2001); and Sharp Genes. Dev. 15:485-90 (2001)]. Although the mechanism of cleavage is still to be elucidated, research indicates that each RISC contains a single siRNA and an RNase [Hutvagner and Zamore Curr. Opin. Genetics and Development 12:225-232 (2002)].

Because of the remarkable potency of RNAi, an amplification step within the RNAi pathway has been suggested. Amplification could occur by copying of the input dsRNAs which would generate more siRNAs, or by replication of the siRNAs formed. Alternatively or additionally, amplification could be effected by multiple turnover events of the RISC [Hammond et al. Nat. Rev. Gen. 2:110-119 (2001), Sharp Genes. Dev. 15:485-90 (2001); Hutvagner and Zamore Curr. Opin. Genetics and Development 12:225-232 (2002)]. For more information on RNAi see the following reviews Tuschl ChemBiochem. 2:239-245 (2001); Cullen Nat. Immunol. 3:597-599 (2002); and Brantl Biochem. Biophys. Act. 1575: 15-25 (2002).

Synthesis of RNAi molecules suitable for use with the present invention can be effected as follows. First, the MSF-A and/or HIF-1α mRNA sequence is scanned downstream of the AUG start codon for AA dinucleotide sequences. Occurrence of each AA and the 3' adjacent 19 nucleotides is recorded as potential siRNA target sites. Preferably, siRNA target sites are selected from the open reading frame, as untranslated regions (UTRs) are richer in regulatory protein binding sites. UTR-binding proteins and/or translation initiation complexes may interfere with binding of the siRNA endonuclease complex [Tuschl, T. 2001, ChemBiochem. 2:239-245]. It will be appreciated though, that siRNAs directed at untranslated regions may also be effective, as demonstrated for GAPDH wherein siRNA directed at the 5' UTR mediated about 90% decrease in cellular GAPDH mRNA and completely abolished protein level (www.ambion.com/techlib/tn/91/912.html).

Second, potential target sites are compared to an appropriate genomic database (e.g., human, mouse, rat etc.) using any sequence alignment software, such as the BLAST software available from the NCBI server (www.ncbi.nlm.nih.gov/BLAST/). Putative target sites which exhibit significant homology to other coding sequences are filtered out.

Qualifying target sequences are selected as template for siRNA synthesis. Preferred sequences are those including low G/C content as these have proven to be more effective in mediating gene silencing as compared to those with G/C content higher than 55%. Several target sites are preferably selected along the length of the target gene for evaluation. For better evaluation of the selected siRNAs, a negative control is preferably used in conjunction. Negative control siRNA preferably include the same nucleotide composition as the siRNAs but lack significant homology to the genome. Thus, a scrambled nucleotide sequence of the siRNA is preferably used, provided it does not display any significant homology to any other gene.

Suitable anti-MSF-A siRNAs can be for example the 5'-GCCUCCUGAGUAAGACUUCtt (SEQ ID NO:4194) or the 5'-CGUGCCUCCUGAGUAAGACtt (SEQ ID NO:4195) siRNA sequences.

Another agent capable of downregulating MSF-A-dependent HIF-α activity, or preventing the formation of an MSF-A-HIF-1α complex is a DNAzyme molecule capable of specifically cleaving an mRNA transcript or DNA sequence of the MSF-A and/or HIF-1α. DNAzymes are single-stranded polynucleotides which are capable of cleaving both single and double stranded target sequences (Breaker, R. R. and Joyce, G. Chemistry and Biology 1995; 2:655; Santoro, S. W. & Joyce, G. F. Proc. Natl, Acad. Sci. USA 1997; 943: 4262). A general model (the "10-23" model) for the DNAzyme has been proposed. "10-23" DNAzymes have a catalytic domain of 15 deoxyribonucleotides, flanked by two substrate-recognition domains of seven to nine deoxyribonucleotides each. This type of DNAzyme can effectively cleave its substrate RNA at purine:pyrimidine junctions (Santoro, S. W. & Joyce, G. F. Proc. Natl, Acad. Sci. USA 199; for rev of DNAzymes see Khachigian, L M [Curr Opin Mol Ther 4:119-21 (2002)].

Examples of construction and amplification of synthetic, engineered DNAzymes recognizing single and double-stranded target cleavage sites have been disclosed in U.S. Pat. No. 6,326,174 to Joyce et al. DNAzymes of similar design directed against the human Urokinase receptor were recently observed to inhibit Urokinase receptor expression, and successfully inhibit colon cancer cell metastasis in vivo (Itoh et al, 20002, Abstract 409, Ann Meeting Am Soc Gen Ther. www.asgt.org). In another application, DNAzymes complementary to bcr-abl oncogenes were successful in inhibiting the oncogenes expression in leukemia cells, and lessening relapse rates in autologous bone marrow transplant in cases of CML and ALL.

Downregulation of MSF-A or HIF-1α can also be effected by using an antisense polynucleotide capable of specifically hybridizing with an mRNA transcript encoding the MSF-A and/or HIF-1α and thus preventing the association between MSF-A and HIF-1α.

Design of antisense molecules which can be used to efficiently down-regulate MSF-A or HIF-1α must be effected while considering two aspects important to the antisense approach. The first aspect is delivery of the oligonucleotide into the cytoplasm of the appropriate cells, while the second aspect is design of an oligonucleotide which specifically binds the designated mRNA within cells in a way which inhibits translation thereof.

The prior art teaches of a number of delivery strategies which can be used to efficiently deliver oligonucleotides into a wide variety of cell types [see, for example, Luft J Mol Med 76: 75-6 (1998); Kronenwett et al. Blood 91: 852-62 (1998); Rajur et al. Bioconjug Chem 8: 935-40 (1997); Lavigne et al. Biochem Biophys Res Commun 237: 566-71 (1997) and Aoki et al. (1997) Biochem Biophys Res Commun 231: 540-5 (1997)].

In addition, algorithms for identifying those sequences with the highest predicted binding affinity for their target mRNA based on a thermodynamic cycle that accounts for the energetics of structural alterations in both the target mRNA and the oligonucleotide are also available [see, for example, Walton et al. Biotechnol Bioeng 65: 1-9 (1999)].

Such algorithms have been successfully used to implement an antisense approach in cells. For example, the algorithm developed by Walton et al. enabled scientists to successfully design antisense oligonucleotides for rabbit beta-globin (RBG) and mouse tumor necrosis factor-alpha (TNF alpha) transcripts. The same research group has more recently reported that the antisense activity of rationally selected oligonucleotides against three model target mRNAs (human lactate dehydrogenase A and B and rat gp130) in cell culture as evaluated by a kinetic PCR technique proved effective in almost all cases, including tests against three different targets in two cell types with phosphodiester and phosphorothioate oligonucleotide chemistries.

In addition, several approaches for designing and predicting efficiency of specific oligonucleotides using an in vitro system were also published (Matveeva et al., Nature Biotechnology 16: 1374-1375 (1998)].

Suitable antisense oligonucleotides which can be utilized to down-regulate MSF-A or HIF-1α expression are exemplified by 5'-GCTCCCTCCAACCAGACTCA-3' (SEQ ID NO:4196) or 5'-GGGTTCTTTGCTTCTGTGTC-3' (SEQ ID NO:4197), respectively.

Several clinical trials have demonstrated safety, feasibility and activity of antisense oligonucleotides. For example, antisense oligonucleotides suitable for the treatment of cancer have been successfully used [Holmund et al., Curr Opin Mol Ther 1:372-85 (1999)], while treatment of hematological malignancies via antisense oligonucleotides targeting c-myb gene, p53 and Bcl-2 had entered clinical trials and had been shown to be tolerated by patients [Gerwitz Curr Opin Mol Ther 1:297-306 (1999)].

More recently, antisense-mediated suppression of human heparanase gene expression has been reported to inhibit pleural dissemination of human cancer cells in a mouse model [Uno et al., Cancer Res 61:7855-60 (2001)].

Thus, the current consensus is that recent developments in the field of antisense technology which, as described above, have led to the generation of highly accurate antisense design algorithms and a wide variety of oligonucleotide delivery systems, enable an ordinarily skilled artisan to design and implement antisense approaches suitable for downregulating expression of known sequences without having to resort to undue trial and error experimentation.

Another agent capable of downregulating MSF-A-dependent HIF-α activity, or preventing the formation of an MSF-A-HIF-1α complex is a ribozyme molecule capable of specifically cleaving an mRNA transcript encoding MSF-A or HIF-1α. Ribozymes are being increasingly used for the sequence-specific inhibition of gene expression by the cleavage of mRNAs encoding proteins of interest [Welch et al., Curr Opin Biotechnol. 9:486-96 (1998)]. The possibility of designing ribozymes to cleave any specific target RNA has rendered them valuable tools in both basic research and therapeutic applications. In the therapeutics area, ribozymes have been exploited to target viral RNAs in infectious diseases, dominant oncogenes in cancers and specific somatic mutations in genetic disorders [Welch et al., Clin Diagn Virol. 10:163-71 (1998)]. Most notably, several ribozyme gene therapy protocols for HIV patients are already in Phase 1 trials. More recently, ribozymes have been used for transgenic animal research, gene target validation and pathway elucidation. Several ribozymes are in various stages of clinical trials. ANGIOZYME was the first chemically synthesized ribozyme to be studied in human clinical trials. ANGIOZYME specifically inhibits formation of the VEGF-r (Vascular Endothelial Growth Factor receptor), a key component in the angiogenesis pathway. Ribozyme Pharmaceuticals, Inc., as well as other firms have demonstrated the importance of anti-angiogenesis therapeutics in animal models. HEPTAZYME, a ribozyme designed to selectively destroy Hepatitis C Virus (HCV) RNA, was found effective in decreasing Hepatitis C viral RNA in cell culture assays (Ribozyme Pharmaceuticals, Incorporated—WEB home page).

Another agent capable of downregulating MSF-A-dependent HIF-1α activity, preventing the formation of an MSF-A-HIF-1α complex or destabilizing an already formed complex can be any molecule which binds to and/or cleaves MSF-A or HIF-1α (e.g., antagonists, or inhibitory peptides) or prevents MSF-A or HIF-1α activation or substrate binding. An example of such a molecule is a non-functional MSF-A polypeptide and/or a non-functional HIF-1α polypeptide.

As used herein, the phrases "non-functional MSF-A polypeptide" and/or a "non-functional HIF-1α polypeptide" refer to any polypeptide lacking at least one function of the MSF-A and/or HIF-1α polypeptides, including, but not limited to, substrate binding or interaction with other proteins. Such a polypeptide can include at least one insertion, deletion or substitution of an amino acid which results in an altered function of the MSF-A and/or the HIF-1α proteins. Non-limiting examples of non-functional MSF-A polypeptides are the N-terminal deleted form of the MSF-A protein as set forth by SEQ ID NO:10 which is encoded by SEQ ID NO:7 and/or the GTP-binding site deleted form of the MSF-A protein as set forth by SEQ ID NO:4215.

It will be appreciated that a non-functional analogue of at least a catalytic or binding portion of either MSF-A or HIF-1α can be also used to prevent the formation of the MSF-A-HIF-1α protein complex. For example, an MSF-A analogue consisting of at least one substituted, inserted or deleted amino acid at the N-terminal of MSF-A (i.e., any of the first 25 amino acids as set forth in SEQ ID NO:3) can be used to prevent MSF-A-dependent activation of HIF-1α.

Such non-functional MSF-A or HIF-1α polypeptides can be utilized per se or can be expressed in cells by ligating a polynucleotide encoding the non-functional MSF-A or HIF-1α polypeptide into an expression vector as is further described hereinbelow.

In addition to the non-functional polypeptides described above, the present invention can also employ peptides, peptide analogues or mimetics thereof which are derived from either the HIF-1α or the MSF-A and which are capable of preventing the formation of, or dissociating, the MSF-A-HIF-1α protein complex.

Such peptides, peptide analogues or mimetics thereof are preferably short amino acid sequences of at least 2 or 3 amino acids, preferably at least 4, more preferably, at least 5, more preferably, in the range of 5-30, even more preferably in the range of 5-25 amino acids which are derived from either the HIF-1α or the MSF-A proteins. A non-limiting example of such a peptide can be the 25 mer peptide derived from the unique N-terminal sequence of MSF-A (SEQ ID NO:3). The amino acid sequence of such a peptide is: Met Lys Lys Ser Tyr Ser Gly Gly Thr Arg Thr Ser Ser Gly Arg Leu Arg Arg Leu Gly Asp Ser Ser Gly Pro as set forth by SEQ ID NO:4213.

As used herein the term "mimetics" refers to molecular structures, which serve as substitutes for the peptide of the present invention in prevention of the formation of or dissociation of the MSF-A-HIF-1α protein complex (Morgan et al. (1989) Ann. Reports Med. Chem. 24:243-252 for a review of peptide mimetics). Peptide mimetics, as used herein, include synthetic structures (known and yet unknown), which may or may not contain amino acids and/or peptide bonds, but retain the structural and functional features of preventing the formation of or dissociating the HIF-1α-MSF-A protein complex. Types of amino acids which can be utilized to generate mimetics are further described hereinbelow. The term, "peptide mimetics" also includes peptoids and oligopeptoids, which are peptides or oligomers of N-substituted amino acids [Simon et al. (1972) Proc. Natl. Acad. Sci. USA 89:9367-9371]. Further included as peptide mimetics are peptide libraries, which are collections of peptides designed to be of a given amino acid length and representing all conceivable sequences of amino acids corresponding thereto. Non-limiting examples of such peptide libraries are provided in SEQ ID NOs:12-2462 or 2463-4193 for peptides derived from HIF-1α or MSF-A, respectively. Methods of producing peptide mimetics are described hereinbelow.

The term "peptide" as used herein encompasses native peptides (either degradation products, synthetically synthesized peptides or recombinant peptides) and as mentioned hereinabove, peptidomimetics (typically, synthetically synthesized peptides), as well as peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, including, but not limited to, CH2-NH, CH2-S, CH2-S=O, O=C—NH, CH2-O, CH2-CH2, S=C—NH, CH=CH or CF=CH, backbone modifications, and residue modification. Methods for preparing peptidomimetic compounds are well known in the art and are specified, for example, in Quantitative Drug Design, C. A. Ramsden Gd., Chapter 17.2, F. Choplin Pergamon Press (1992), which is incorporated by reference as if fully set forth herein. Further details in this respect are provided hereinunder.

Peptide bonds (—CO—NH—) within the peptide may be substituted, for example, by N-methylated bonds (—N(CH3)-CO—), ester bonds (—C(R)H—C—O—O—C(R)—N—), ketomethylen bonds (—CO—CH2-), α-aza bonds (—NH—N(R)—CO—), wherein R is any alkyl, e.g., methyl, carba bonds (—CH2-NH—), hydroxyethylene bonds (—CH(OH)—CH2-), thioamide bonds (—CS—NH—), olefinic double bonds (—CH=CH—), retro amide bonds (—NH—

CO—), peptide derivatives (—N(R)—CH2-CO—), wherein R is the "normal" side chain, naturally presented on the carbon atom.

These modifications can occur at any of the bonds along the peptide chain and even at several (2-3) at the same time.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the peptides of the present invention may also include one or more modified amino acids or one or more non-amino acid monomers (e.g. fatty acids, complex carbohydrates etc).

As used herein in the specification the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids.

Tables 1 and 2 below list naturally occurring amino acids (Table 1) and non-conventional or modified amino acids (Table 2) which can be used with the present invention.

TABLE 1

| Amino Acid | Three-Letter Abbreviation | One-letter Symbol |
| --- | --- | --- |
| alanine | Ala | A |
| Arginine | Arg | R |
| Asparagine | Asn | N |
| Aspartic acid | Asp | D |
| Cysteine | Cys | C |
| Glutamine | Gln | Q |
| Glutamic Acid | Glu | E |
| glycine | Gly | G |
| Histidine | His | H |
| isoleucine | Iie | I |
| leucine | Leu | L |
| Lysine | Lys | K |
| Methionine | Met | M |
| phenylalanine | Phe | F |
| Proline | Pro | P |
| Serine | Ser | S |
| Threonine | Thr | T |
| tryptophan | Trp | W |
| tyrosine | Tyr | Y |
| Valine | Val | V |
| Any amino acid as above | Xaa | X |

TABLE 2

| Non-conventional amino acid | Code | Non-conventional amino acid | Code |
| --- | --- | --- | --- |
| α-aminobutyric acid | Abu | L-N-methylalanine | Nmala |
| α-amino-α-methylbutyrate | Mgabu | L-N-methylarginine | Nmarg |
| aminocyclopropane-carboxylate | Cpro | L-N-methylasparagine | Nmasn |
|  |  | L-N-methylaspartic acid | Nmasp |
| aminoisobutyric acid | Aib | L-N-methylcysteine | Nmcys |
| aminonorbornyl-carboxylate | Norb | L-N-methylglutamine | Nmgln |
|  |  | L-N-methylglutamic acid | Nmglu |
| cyclohexylalanine | Chexa | L-N-methylhistidine | Nmhis |
| cyclopentylalanine | Cpen | L-N-methylisolleucine | Nmile |
| D-alanine | Dal | L-N-methylleucine | Nmleu |
| D-arginine | Darg | L-N-methyllysine | Nmlys |
| D-aspartic acid | Dasp | L-N-methylmethionine | Nmmet |
| D-cysteine | Dcys | L-N-methylnorleucine | Nmnle |
| D-glutamine | Dgln | L-N-methylnorvaline | Nmnva |
| D-glutamic acid | Dglu | L-N-methylornithine | Nmorn |
| D-histidine | Dhis | L-N-methylphenylalanine | Nmphe |
| D-isoleucine | Dile | L-N-methylproline | Nmpro |
| D-leucine | Dleu | L-N-methylserine | Nmser |
| D-lysine | Dlys | L-N-methylthreonine | Nmthr |
| D-methionine | Dmet | L-N-methyltryptophan | Nmtrp |
| D-ornithine | Dorn | L-N-methyltyrosine | Nmtyr |
| D-phenylalanine | Dphe | L-N-methylvaline | Nmval |
| D-proline | Dpro | L-N-methylethylglycine | Nmetg |
| D-serine | Dser | L-N-methyl-t-butylglycine | Nmtbug |
| D-threonine | Dthr | L-norleucine | Nle |
| D-tryptophan | Dtrp | L-norvaline | Nva |
| D-tyrosine | Dtyr | α-methyl-aminoisobutyrate | Maib |
| D-valine | Dval | α-methyl-γ-aminobutyrate | Mgabu |
| D-α-methylalanine | Dmala | α-methylcyclohexylalanine | Mchexa |
| D-α-methylarginine | Dmarg | α-methylcyclopentylalanine | Mcpen |
| D-α-methylasparagine | Dmasn | α-methyl-α-napthylalanine | Manap |
| D-α-methylaspartate | Dmasp | α-methylpenicillamine | Mpen |
| D-α-methylcysteine | Dmcys | N-(4-aminobutyl)glycine | Nglu |
| D-α-methylglutamine | Dmgln | N-(2-aminoethyl)glycine | Naeg |
| D-α-methylhistidine | Dmhis | N-(3-aminopropyl)glycine | Norn |
| D-α-methylisoleucine | Dmile | N-amino-α-methylbutyrate | Nmaabu |
| D-α-methylleucine | Dmleu | α-napthylalanine | Anap |
| D-α-methyllysine | Dmlys | N-benzylglycine | Nphe |
| D-α-methylmethionine | Dmmet | N-(2-carbamylethyl)glycine | Ngln |
| D-α-methylornithine | Dmorn | N-(carbamylmethyl)glycine | Nasn |
| D-α-methylphenylalanine | Dmphe | N-(2-carboxyethyl)glycine | Nglu |
| D-α-methylproline | Dmpro | N-(carboxymethyl)glycine | Nasp |
| D-α-methylserine | Dmser | N-cyclobutylglycine | Ncbut |
| D-α-methylthreonine | Dmthr | N-cycloheptylglycine | Nchep |
| D-α-methyltryptophan | Dmtrp | N-cyclohexylglycine | Nchex |
| D-α-methyltyrosine | Dmty | N-cyclodecylglycine | Ncdec |

TABLE 2-continued

| Non-conventional amino acid | Code | Non-conventional amino acid | Code |
|---|---|---|---|
| D-α-methylvaline | Dmval | N-cyclododeclglycine | Ncdod |
| D-α-methylalnine | Dnmala | N-cyclooctylglycine | Ncoct |
| D-α-methylarginine | Dnmarg | N-cyclopropylglycine | Ncpro |
| D-α-methylasparagine | Dnmasn | N-cycloundecylglycine | Ncund |
| D-α-methylasparatate | Dnmasp | N-(2,2-diphenylethyl)glycine | Nbhm |
| D-α-methylcysteine | Dnmcys | N-(3,3-diphenylpropyl)glycine | Nbhe |
| D-N-methylleucine | Dnmleu | N-(3-indolylyethyl) glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nva |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomo phenylalanine | Mhphe |
| L-α-methylisoleucine | Mile | N-(2-methylthioethyl)glycine | Nmet |
| D-N-methylglutamine | Dnmgln | N-(3-guanidinopropyl)glycine | Narg |
| D-N-methylglutamate | Dnmglu | N-(1-hydroxyethyl)glycine | Nthr |
| D-N-methylhistidine | Dnmhis | N-(hydroxyethyl)glycine | Nser |
| D-N-methylisoleucine | Dnmile | N-(imidazolylethyl)glycine | Nhis |
| D-N-methylleucine | Dnmleu | N-(3-indolylyethyl)glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nval |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| L-α-methylleucine | Mleu | L-α-methyllysine | Mlys |
| L-α-methylmethionine | Mmet | L-α-methylnorleucine | Mnle |
| L-α-methylnorvaline | Mnva | L-α-methylornithine | Morn |
| L-α-methylphenylalanine | Mphe | L-α-methylproline | Mpro |
| L-α-methylserine | mser | L-α-methylthreonine | Mthr |
| L-α-methylvaline | Mtrp | L-α-methyltyrosine | Mtyr |
| L-α-methylleucine | Mval Nnbhm | L-N-methylhomophenylalanine | Nmhphe |
| N-(N-(2,2-diphenylethyl) carbamylmethyl-glycine | Nnbhm | N-(N-(3,3-diphenylpropyl) carbamylmethyl(1)glycine | Nnbhe |
| 1-carboxy-1-(2,2-diphenyl ethylamino)cyclopropane | Nmbc | | |

Since the present peptides are preferably utilized in therapeutics or diagnostics which require the peptides to be in soluble form, the peptides of the present invention preferably include one or more non-natural or natural polar amino acids, including but not limited to serine and threonine which are capable of increasing peptide solubility due to their hydroxyl-containing side chain.

The peptides of the present invention are preferably utilized in a linear form, although it will be appreciated that in cases where cyclicization does not severely interfere with peptide characteristics, cyclic forms of the peptide can also be utilized.

The peptides of present invention can be biochemically synthesized such as by using standard solid phase techniques. These methods include exclusive solid phase synthesis, partial solid phase synthesis methods, fragment condensation and classical solution synthesis. These methods are preferably used when the peptide is relatively short (i.e., 10 kDa) and/or when it cannot be produced by recombinant techniques (i.e., not encoded by a nucleic acid sequence) and therefore involve different chemistry.

Solid phase peptide synthesis procedures are well known in the art and further described by John Morrow Stewart and Janis Dillaha Young, Solid Phase Peptide Syntheses (2nd Ed., Pierce Chemical Company, 1984).

Synthetic peptides can be purified by preparative high performance liquid chromatography [Creighton T. (1983) Proteins, structures and molecular principles. WH Freeman and Co. N.Y.] and the composition of which can be confirmed via amino acid sequencing.

In cases where large amounts of the peptides of the present invention are desired, the peptides of the present invention can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680, Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

Generation of peptide mimetics, as described hereinabove, is effected using various approaches, including, for example, display techniques, using a plurality of display vehicles (such as phages, viruses or bacteria) each displaying a short peptide sequence as described hereinabove. For example, a display library containing peptides derived from HIF-1α or MSF-A (as set forth by SEQ ID NOs:12-2462 or 2463-4193, respectively) can be screened with MSF-A or HIF-1α (respectively) in order to identify peptides capable of binding one or both constituents of this protein complex. Such peptides would be potentially capable of preventing the formation of the complex or capable of destabilizing the complex.

Methods of constructing and screening peptide display libraries are well known in the art. Such methods are described in, for example, Young A C, et al., "The three-dimensional structures of a polysaccharide binding antibody to Cryptococcus neoformans and its complex with a peptide from a phage display library: implications for the identification of peptide mimotopes" J Mol Biol 1997 Dec. 12; 274(4): 622-34; Giebel L B et al. "Screening of cyclic peptide phage libraries identifies ligands that bind streptavidin with high affinities" Biochemistry 1995 Nov. 28; 34(47):15430-5; Davies E L et al., "Selection of specific phage-display antibodies using libraries derived from chicken immunoglobulin genes" J Immunol Methods 1995 Oct. 12; 186(1):125-35; Jones C R T al. "Current trends in molecular recognition and bioseparation" J Chromatogr A 1995 Jul. 14; 707(1):3-22; Deng S J et al. "Basis for selection of improved carbohydrate-binding single-chain antibodies from synthetic gene libraries" Proc Natl Acad Sci USA 1995 May 23; 92(11):4992-6; and Deng S J et al. "Selection of antibody single-chain variable fragments with improved carbohydrate binding by phage display" J Biol Chem 1994 Apr. 1; 269(13):9533-8, which are incorporated herein by reference.

Peptide mimetics can also be uncovered using computational biology. For example, various compounds can be computationally analyzed for an ability to prevent the formation of or dissociate the MSF-A-HIF-1α protein complex using a variety of three-dimensional computational tools. Software programs useful for displaying three-dimensional structural models, such as RIBBONS (Carson, M., 1997. Methods in Enzymology 277, 25), O (Jones, T A. et al., 1991. Acta Crystallogr. A47, 110), DINO (DINO: Visualizing Structural Biology (2001) http://www.dino3d.org); and QUANTA, INSIGHT, SYBYL, MACROMODE, ICM, MOLMOL, RASMOL and GRASP (reviewed in Kraulis, J., 1991. Appl Crystallogr. 24, 946) can be utilized to model interactions between the MSF-A-HIF-1α protein complex and prospective peptide mimetics to thereby identify peptides which display the highest probability of binding and interfering of the association between MSF-A and HIF-1α. Computational modeling of protein-peptide interactions has been successfully used in rational drug design, for further detail, see Lam et al., 1994. Science 263, 380; Wlodawer et al., 1993. Ann Rev Biochem. 62, 543; Appelt, 1993. Perspectives in Drug Discovery and Design 1, 23; Erickson, 1993. Perspectives in Drug Discovery and Design 1, 109, and Mauro M J. et al., 2002. J Clin Oncol. 20, 325-34.

Aptamers are nucleic acids or oligonucleotide molecules, typically of 10-15 kDa in size (30-45 nucleotides) which are capable of specifically binding to selected targets and altering their activity.

Aptamers may be double-stranded or single-stranded, and may include deoxyribonucleotides, ribonucleotides, nucleotide derivatives, or other nucleotide-like molecules. The nucleotide components of an aptamer may have modified sugar groups (e.g., the 2'-OH group of a ribonucleotide may be replaced by 2'-F or 2'—NH2), which may improve a desired property, e.g., resistance to nucleases or longer lifetime in vivo. Aptamers may be conjugated to other molecules, e.g., a high molecular weight carrier to slow the clearance of the aptamer from the circulatory system, or they can be specifically cross-linked to their cognate ligands, e.g., by photo-activation of a cross-linker (See, e.g., Brody, E. N. and L. Gold (2000) J. Biotechnol. 74:5-13.)

Aptamers are produced using in vitro selection processes which allow the specificity and affinity of the aptamer to be tightly controlled.

A suitable method for generating an aptamer to a target of interest (e.g., the MSF-A, the HIF-1α and/or the MSF-A-HIF1α complex) is the "Systematic Evolution of Ligands by EXponential Enrichment" (SELEX™). The SELEX™ method is described in U.S. patent application Ser. No. 07/536,428, filed Jun. 11, 1990, now abandoned, U.S. Pat. No. 5,475,096 entitled "Nucleic Acid Ligands", and U.S. Pat. No. 5,270,163 (see also WO 91/19813) entitled "Nucleic Acid Ligands". Briefly, a mixture of nucleic acids is contacted with the target molecule under conditions favorable for binding. The unbound nucleic acids are partitioned from the bound nucleic acids, and the nucleic acid-target complexes are dissociated. Then the dissociated nucleic acids are amplified to yield a ligand-enriched mixture of nucleic acids, which is subjected to repeated cycles of binding, partitioning, dissociating and amplifying as desired to yield highly specific high affinity nucleic acid ligands to the target molecule.

Aptamers have been generated for over 100 proteins including growth factors, transcription factors, enzymes, immunoglobulins, and receptors. Typical aptamers bind to their targets with sub-nanomolar affinity and discriminate against closely related targets (i.e., other proteins from the same gene family). A series of structural studies have shown that aptamers are capable of using the same types of binding interactions (hydrogen bonding, electrostatic complementarity, hydrophobic contacts, and steric exclusion) that drive affinity and specificity in antibody-antigen complexes.

Thus, the teachings of the present invention can be used to treat cancer or cancerous tumors. Briefly, an agent capable of preventing the formation of or dissociating the MSF-A-HIF-1α protein complex such as the siRNA set forth by SEQ ID NO:4195 which is designed for downregulating the MSF-A mRNA is administered to the individual as part of a pharmaceutical composition (as described hereinbelow) along with a pharmaceutical acceptable carrier (e.g., calcium carbonate). It should be noted that since siRNA molecules typically have a limited half-life the treatment described above is preferably repeated periodically in order to prevent tumor growth or progression of cancer.

Although as described hereinabove, activation of HIF-1α through the HIF-1α-MSF-A protein complex is associated with cancerous tumors and cancer metastases, there are several clinical conditions in which activation of HIF-1α is desired. For example, in the case of acute ischemia, where the oxygen tension decreases (i.e., hypoxia conditions), HIF-1α is stabilized and thus activates transcription of various target genes which contribute to angiogenesis. However, such activation is temporary and often can not overcome and correct the damage caused by the acute ischemia.

While reducing the present invention to practice, the present inventor has uncovered that upregulation of MSF-A-dependent HIF-1α activity and/or stabilization of the MSF-A-HIF-1α protein complex can be used to activate HIF-1α and to treat acute ischemia.

Thus, according to another aspect of the present invention there is provided a method of treating acute ischemia in cells of an individual.

The method is effected by providing to the individual an agent capable of upregulating an MSF-A-dependent HIF-1α activity and/or stabilizing an MSF-A-HIF-1α protein complex in cells of the individual to thereby treat the acute ischemia.

The term "individual" as used herein encompasses both males and females at any age which are at risk to develop ischemic diseases. For example, smokers or individuals with high blood pressure, diabetes, hypercholesterolemia, a coronary disease, cerebral vascular diseases and atherosclerosis.

According to preferred embodiments of the present invention the acute ischemia is a result of stroke or acute myocardial infraction.

As used herein the term "upregulating" refers to increasing the expression level and/or activity of MSF-A and/or HIF-1α proteins.

The term "stabilizing" refers to increasing the stability of the MSF-A-HIF-1α protein complex, i.e., enabling the protein complex to retain the interactions between the MSF-A and HIF-1α which consist of the protein complex. It will be appreciated that stabilization of the MSF-A-HIF-1α protein complex can be achieved, for example, by upregulating the expression level and/or activity of the MSF-A and/or the HIF-1α proteins.

Upregulation of the expression level and/or activity of MSF-A or HIF-1α can be effected at the genomic level (i.e., activation of transcription via promoters, enhancers, regulatory elements), at the transcript level (i.e., correct splicing, polyadenylation, activation of translation) or at the protein level (i.e., post-translational modifications, interaction with substrates and the like). Preferably, agents capable of increasing the association between MSF-A and HIF-1α can be used along with the present invention.

Following is a list of agents capable of upregulating the expression level and/or activity of MSF-A or HIF-1α.

An agent capable of upregulating expression level of MSF-A or HIF-1α may be an exogenous polynucleotide sequence designed and constructed to express at least a functional portion of the MSF-A or HIF-1α proteins. Accordingly, the exogenous polynucleotide sequence may be a DNA or RNA sequence encoding the MSF-A or HIF-1α molecules, capable of forming the MSF-A-HIF-1α protein complex.

The phrase "functional portion" as used herein refers to part of the MSF-A or HIF-1α proteins (i.e., a polypeptide) which exhibits functional properties of the enzyme such as binding a substrate or another protein, forming a protein complex and the like. According to preferred embodiments of the present invention the functional portion of MSF-A or HIF-1α is a polypeptide sequence including amino acids 1-586 as set forth in SEQ ID NO:3 or a polypeptide sequence including amino acids 1-826 as set forth in SEQ ID NO:11, respectively. Preferably, the functional portion of HIF-1α is a polypeptide sequence including amino acids 37-373, more preferably, amino acids 36-821 as set forth in SEQ ID NO:11.

MSF-A and HIF-1α have been cloned from human, mouse (HIF-1α) and rat (HIF-1α) sources. Thus, coding sequences information for MSF-A and/or HIF-1α is available from several databases including the GenBank database available through http://www.ncbi.nlm.nih.gov/.

To express exogenous MSF-A or HIF-1α in mammalian cells, a polynucleotide sequence encoding MSF-A or HIF-1α (SEQ ID NO:1 or 2, respectively) is preferably ligated into a nucleic acid construct suitable for mammalian cell expression. Such a nucleic acid construct includes a promoter sequence for directing transcription of the polynucleotide sequence in the cell in a constitutive or inducible manner.

It will be appreciated that the nucleic acid construct of the present invention can also utilize MSF-A or HIF-1α homologues which exhibit the desired activity. Such homologues can be, for example, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% or 100% identical to SEQ ID NO:1 or 2, respectively, as determined using the BestFit software of the Wisconsin sequence analysis package, utilizing the Smith and Waterman algorithm, where gap weight equals 50, length weight equals 3, average match equals 10 and average mismatch equals-9.

Constitutive promoters suitable for use with the present invention are promoter sequences which are active under most environmental conditions and most types of cells such as the cytomegalovirus (CMV) and Rous sarcoma virus (RSV). Inducible promoters suitable for use with the present invention include for example the tetracycline-inducible promoter [Zabala M, et al., Cancer Res. 2004, 64(8): 2799-804].

The nucleic acid construct (also referred to herein as an "expression vector") of the present invention includes additional sequences which render this vector suitable for replication and integration in prokaryotes, eukaryotes, or preferably both (e.g., shuttle vectors). In addition, a typical cloning vectors may also contain a transcription and translation initiation sequence, transcription and translation terminator and a polyadenylation signal.

Eukaryotic promoters typically contain two types of recognition sequences, the TATA box and upstream promoter elements. The TATA box, located 25-30 base pairs upstream of the transcription initiation site, is thought to be involved in directing RNA polymerase to begin RNA synthesis. The other upstream promoter elements determine the rate at which transcription is initiated.

Enhancer elements can stimulate transcription up to 1,000 fold from linked homologous or heterologous promoters. Enhancers are active when placed downstream or upstream from the transcription initiation site. Many enhancer elements derived from viruses have a broad host range and are active in a variety of tissues. For example, the SV40 early gene enhancer is suitable for many cell types. Other enhancer/promoter combinations that are suitable for the present invention include those derived from polyoma virus, human or murine cytomegalovirus (CMV), the long term repeat from various retroviruses such as murine leukemia virus, murine or Rous sarcoma virus and HIV. See, Enhancers and Eukaryotic Expression, Cold Spring Harbor Press, Cold Spring Harbor, N.Y. 1983, which is incorporated herein by reference.

In the construction of the expression vector, the promoter is preferably positioned approximately the same distance from the heterologous transcription start site as it is from the transcription start site in its natural setting. As is known in the art, however, some variation in this distance can be accommodated without loss of promoter function.

Polyadenylation sequences can also be added to the expression vector in order to increase the efficiency of MSF-A/or HIF-1α mRNA translation. Two distinct sequence elements are required for accurate and efficient polyadenylation: GU or U rich sequences located downstream from the polyadenylation site and a highly conserved sequence of six nucleotides, AAUAAA, located 11-30 nucleotides upstream. Termination and polyadenylation signals that are suitable for the present invention include those derived from SV40.

In addition to the elements already described, the expression vector of the present invention may typically contain other specialized elements intended to increase the level of expression of cloned nucleic acids or to facilitate the identification of cells that carry the recombinant DNA. For example, a number of animal viruses contain DNA sequences that promote the extra chromosomal replication of the viral genome in permissive cell types. Plasmids bearing these viral replicons are replicated episomally as long as the appropriate factors are provided by genes either carried on the plasmid or with the genome of the host cell.

The vector may or may not include a eukaryotic replicon. If a eukaryotic replicon is present, then the vector is amplifiable in eukaryotic cells using the appropriate selectable marker. If the vector does not comprise a eukaryotic replicon, no episomal amplification is possible. Instead, the recombinant DNA integrates into the genome of the engineered cell, where the promoter directs expression of the desired nucleic acid.

The expression vector of the present invention can further include additional polynucleotide sequences that allow, for example, the translation of several proteins from a single mRNA such as an internal ribosome entry site (IRES) and sequences for genomic integration of the promoter-chimeric polypeptide. It will be appreciated that such an expression vector can include the coding sequence of both MSF-A and HIF-1α to enable translation of both proteins.

Examples for mammalian expression vectors include, but are not limited to, pcDNA3, pcDNA3.1(+/−), pGL3, pZeoSV2(+/−), pSecTag2, pDisplay, pEF/myc/cyto, pCMV/myc/cyto, pCR3.1, pSinRep5, DH26S, DHBB, pNMT1, pNMT41, pNMT81, which are available from Invitrogen, pCI which is available from Promega, pMbac, pPbac, pBK-RSV and pBK-CMV which are available from Strategene, pTRES which is available from Clontech, and their derivatives.

Expression vectors containing regulatory elements from eukaryotic viruses such as retroviruses can be also used. SV40 vectors include pSVT7 and pMT2. Vectors derived from bovine papilloma virus include pBV-1MTHA, and vectors derived from Epstein Bar virus include pHEBO, and p2O5. Other exemplary vectors include pMSG, pAV009/A+, pMTO10/A+, pMAMneo-5, baculovirus pDSVE, and any other vector allowing expression of proteins under the direction of the SV-40 early promoter, SV-40 later promoter, metallothionein promoter, murine mammary tumor virus promoter, Rous sarcoma virus promoter, polyhedrin promoter, or other promoters shown effective for expression in eukaryotic cells.

As described above, viruses are very specialized infectious agents that have evolved, in many cases, to elude host defense mechanisms. Typically, viruses infect and propagate in specific cell types. The targeting specificity of viral vectors utilizes its natural specificity to specifically target predetermined cell types and thereby introduce a recombinant gene into the infected cell. Thus, the type of vector used by the present invention will depend on the cell type transformed. The ability to select suitable vectors according to the cell type transformed is well within the capabilities of the ordinary skilled artisan and as such no general description of selection consideration is provided herein. For example, bone marrow cells can be targeted using the human T cell leukemia virus type I (HTLV-I) and kidney cells may be targeted using the heterologous promoter present in the baculovirus *Autographa californica* nucleopolyhedrovirus (AcMNPV) as described in Liang C Y et al., 2004 (Arch Virol. 149: 51-60).

Recombinant viral vectors are useful for in vivo expression of MSF-A or HIF-1α since they offer advantages such as lateral infection and targeting specificity. Lateral infection is inherent in the life cycle of, for example, retrovirus and is the process by which a single infected cell produces many progeny virions that bud off and infect neighboring cells. The result is that a large area becomes rapidly infected, most of which was not initially infected by the original viral particles. This is in contrast to vertical-type of infection in which the infectious agent spreads only through daughter progeny. Viral vectors can also be produced that are unable to spread laterally. This characteristic can be useful if the desired purpose is to introduce a specified gene into only a localized number of targeted cells.

Various methods can be used to introduce the expression vector of the present invention into stem cells. Such methods are generally described in Sambrook et al., Molecular Cloning: A Laboratory Manual, Cold Springs Harbor Laboratory, New York (1989, 1992), in Ausubel et al., Current Protocols in Molecular Biology, John Wiley and Sons, Baltimore, Md. (1989), Chang et al., Somatic Gene Therapy, CRC Press, Ann Arbor, Mich. (1995), Vega et al., Gene Targeting, CRC Press, Ann Arbor Mich. (1995), Vectors: A Survey of Molecular Cloning Vectors and Their Uses, Butterworths, Boston Mass. (1988) and Gilboa et al. [Biotechniques 4 (6): 504-512, 1986] and include, for example, stable or transient transfection, lipofection, electroporation and infection with recombinant viral vectors. In addition, see U.S. Pat. Nos. 5,464,764 and 5,487,992 for positive-negative selection methods.

Introduction of nucleic acids by viral infection offers several advantages over other methods such as lipofection and electroporation, since higher transfection efficiency can be obtained due to the infectious nature of viruses.

It will be appreciated that upregulation of MSF-A and/or HIF-1α can be also effected by administration of MSF-A and/or HIF-1α-expressing cells into the individual.

MSF-A and/or HIF-1α-expressing cells can be any suitable cells, such as cardiac cells, bone marrow and lymphocyte cells which are derived from the individuals and are transfected ex vivo with one or two expression vectors containing the polynucleotide(s) designed to express MSF-A and/or HIF-1α as described hereinabove.

Administration of the MSF-A and/or HIF-1α-expressing cells of the present invention can be effected using any suitable route such as intravenous, intra peritoneal, intra kidney, intra gastrointestinal track, subcutaneous, transcutaneous, intramuscular, intracutaneous, intrathecal, epidural and rectal. According to presently preferred embodiments, the MSF-A and/or HIF-1α-expressing cells of the present invention are introduced to the individual using intravenous, intra cardiac, intra gastrointestinal track and/or intra peritoneal administrations.

MSF-A and/or HIF-1α-expressing cells of the present invention can be derived from either autologous sources such as self bone marrow cells or from allogeneic sources such as bone marrow or other cells derived from non-autologous sources. Since non-autologous cells are likely to induce an immune reaction when administered to the body several approaches have been developed to reduce the likelihood of rejection of non-autologous cells. These include either suppressing the recipient immune system or encapsulating the non-autologous cells or tissues in immunoisolating, semipermeable membranes before transplantation.

Encapsulation techniques are generally classified as microencapsulation, involving small spherical vehicles and macroencapsulation, involving larger flat-sheet and hollow-fiber membranes (Uludag, H. et al. Technology of mammalian cell encapsulation. Adv Drug Deliv Rev. 2000; 42: 29-64).

Methods of preparing microcapsules are known in the arts and include for example those disclosed by Lu M Z, et al., Cell encapsulation with alginate and alpha-phenoxycinnamylidene-acetylated poly(allylamine). Biotechnol Bioeng. 2000, 70: 479-83, Chang T M and Prakash S. Procedures for microencapsulation of enzymes, cells and genetically engineered microorganisms. Mol. Biotechnol. 2001, 17: 249-60, and Lu M Z, et al., A novel cell encapsulation method using photosensitive poly(allylamine alpha-cyanocinnamylidene-acetate). J. Microencapsul. 2000, 17: 245-51.

For example, microcapsules are prepared by complexing modified collagen with a ter-polymer shell of 2-hydroxyethyl methylacrylate (HEMA), methacrylic acid (MAA) and methyl methacrylate (MMA), resulting in a capsule thickness of 2-5 μm. Such microcapsules can be further encapsulated with additional 2-5 μm ter-polymer shells in order to impart a negatively charged smooth surface and to minimize plasma protein absorption (Chia, S. M. et al. Multi-layered microcapsules for cell encapsulation Biomaterials. 2002 23: 849-56).

Other microcapsules are based on alginate, a marine polysaccharide (Sambanis, A. Encapsulated islets in diabetes treatment. Diabetes Thechnol. Ther. 2003, 5: 665-8) or its derivatives. For example, microcapsules can be prepared by the polyelectrolyte complexation between the polyanions sodium alginate and sodium cellulose sulphate with the polycation poly(methylene-co-guanidine) hydrochloride in the presence of calcium chloride.

It will be appreciated that cell encapsulation is improved when smaller capsules are used. Thus, the quality control, mechanical stability, diffusion properties, and in vitro activities of encapsulated cells improved when the capsule size was reduced from 1 mm to 400 μm (Canaple L. et al., Improving cell encapsulation through size control. J Biomater Sci Polym Ed. 2002; 13: 783-96). Moreover, nanoporous biocapsules with well-controlled pore size as small as 7 nm, tailored surface chemistries and precise microarchitectures were found to successfully immunoisolate microenvironments for cells (Williams D. Small is beautiful: microparticle and nanoparticle technology in medical devices. Med Device Technol. 1999, 10: 6-9; Desai, T. A. Microfabrication technology for pancreatic cell encapsulation. Expert Opin Biol Ther. 2002, 2: 633-46).

An agent capable of upregulating the MSF-A or HIF-1α may also be any compound which is capable of increasing the transcription and/or translation of an endogenous DNA or mRNA encoding the MSF-A or HIF-1α and thus increasing endogenous MSF-A or HIF-1α activity, respectively.

An agent capable of upregulating the MSF-A or HIF-1α may also be an exogenous polypeptide including at least a functional portion (as described hereinabove) of the MSF-A or HIF-1α proteins.

Upregulation of MSF-A or HIF-1α can be also achieved by introducing at least one MSF-A or HIF-1α substrate or inducer. Non-limiting examples of such agents include PHD inhibitors, Capsaicin (8-methyl-N-Vanillyl-6nonenamide), DBM (dibenzoylmethane), CPX (ciclopirox olamine), Deferoxamine, Mersalyl, Chromium, $CoCl_2$ which are known to induce HIF-1α expression and/or activity (Paul et al., 2004; J. Cell Physiol. 200: 20-30).

It will be appreciated that stabilization of the MSF-A-HIF1α protein complex can be also effected using a polypeptide capable of stabilizing the MSF-A-HIF1α protein complex.

Each of the upregulating, stabilizing or downregulating agents described hereinabove or the expression vector encoding MSF-A and/or HIF-1α or portions thereof can be administered to the individual per se or as part of a pharmaceutical composition which also includes a physiologically acceptable carrier. The purpose of a pharmaceutical composition is to facilitate administration of the active ingredient to an organism.

As used herein a "pharmaceutical composition" refers to a preparation of one or more of the active ingredients described herein with other chemical components such as physiologically suitable carriers and excipients. The purpose of a pharmaceutical composition is to facilitate administration of a compound to an organism.

Herein the term "active ingredient" refers to the upregulating, stabilizing or downregulating agent or the expression vector encoding MSF-A and/or HIF-1α which are accountable for the biological effect.

Hereinafter, the phrases "physiologically acceptable carrier" and "pharmaceutically acceptable carrier" which may be interchangeably used refer to a carrier or a diluent that does not cause significant irritation to an organism and does not abrogate the biological activity and properties of the administered compound. An adjuvant is included under these phrases.

Herein the term "excipient" refers to an inert substance added to a pharmaceutical composition to further facilitate administration of an active ingredient. Examples, without limitation, of excipients include calcium carbonate, various sugars and types of starch, cellulose derivatives, gelatin, vegetable oils and polyethylene glycols.

Techniques for formulation and administration of drugs may be found in "Remington's Pharmaceutical Sciences," Mack Publishing Co., Easton, Pa., latest edition, which is incorporated herein by reference.

Suitable routes of administration may, for example, include oral, rectal, transmucosal, especially transnasal, intestinal or parenteral delivery, including intramuscular, subcutaneous and intramedullary injections as well as intrathecal, direct intraventricular, intravenous, intraperitoneal, intranasal, or intraocular injections.

Alternately, one may administer the pharmaceutical composition in a local rather than systemic manner, for example, via injection of the pharmaceutical composition directly into a tissue region of a patient.

Pharmaceutical compositions of the present invention may be manufactured by processes well known in the art, e.g., by means of conventional mixing, dissolving, granulating, dragee-making, levigating, emulsifying, encapsulating, entrapping or lyophilizing processes.

Pharmaceutical compositions for use in accordance with the present invention thus may be formulated in conventional manner using one or more physiologically acceptable carriers comprising excipients and auxiliaries, which facilitate processing of the active ingredients into preparations which, can be used pharmaceutically. Proper formulation is dependent upon the route of administration chosen.

For injection, the active ingredients of the pharmaceutical composition may be formulated in aqueous solutions, preferably in physiologically compatible buffers such as Hank's solution, Ringer's solution, or physiological salt buffer. For transmucosal administration, penetrants appropriate to the barrier to be permeated are used in the formulation. Such penetrants are generally known in the art.

For oral administration, the pharmaceutical composition can be formulated readily by combining the active compounds with pharmaceutically acceptable carriers well known in the art. Such carriers enable the pharmaceutical composition to be formulated as tablets, pills, dragees, capsules, liquids, gels, syrups, slurries, suspensions, and the like, for oral ingestion by a patient. Pharmacological preparations for oral use can be made using a solid excipient, optionally grinding the resulting mixture, and processing the mixture of granules, after adding suitable auxiliaries if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP). If desired, disintegrating agents may be added, such as cross-linked polyvinyl pyrrolidone, agar, or alginic acid or a salt thereof such as sodium alginate.

Dragee cores are provided with suitable coatings. For this purpose, concentrated sugar solutions may be used which may optionally contain gum arabic, talc, polyvinyl pyrrolidone, carbopol gel, polyethylene glycol, titanium dioxide, lacquer solutions and suitable organic solvents or solvent mixtures. Dyestuffs or pigments may be added to the tablets or dragee coatings for identification or to characterize different combinations of active compound doses.

Pharmaceutical compositions which can be used orally, include push-fit capsules made of gelatin as well as soft, sealed capsules made of gelatin and a plasticizer, such as glycerol or sorbitol. The push-fit capsules may contain the active ingredients in admixture with filler such as lactose, binders such as starches, lubricants such as talc or magnesium stearate and, optionally, stabilizers. In soft capsules, the active ingredients may be dissolved or suspended in suitable liquids, such as fatty oils, liquid paraffin, or liquid polyethylene glycols. In addition, stabilizers may be added. All formulations for oral administration should be in dosages suitable for the chosen route of administration.

For buccal administration, the compositions may take the form of tablets or lozenges formulated in conventional manner.

For administration by nasal inhalation, the active ingredients for use according to the present invention are conveniently delivered in the form of an aerosol spray presentation from a pressurized pack or a nebulizer with the use of a suitable propellant, e.g., dichlorodifluoromethane, trichlorofluoromethane, dichloro-tetrafluoroethane or carbon dioxide. In the case of a pressurized aerosol, the dosage unit may be determined by providing a valve to deliver a metered amount.

Capsules and cartridges of, e.g., gelatin for use in a dispenser may be formulated containing a powder mix of the compound and a suitable powder base such as lactose or starch.

The pharmaceutical composition described herein may be formulated for parenteral administration, e.g., by bolus injection or continuous infusion. Formulations for injection may be presented in unit dosage form, e.g., in ampoules or in multidose containers with optionally, an added preservative. The compositions may be suspensions, solutions or emulsions in oily or aqueous vehicles, and may contain formulatory agents such as suspending, stabilizing and/or dispersing agents.

Pharmaceutical compositions for parenteral administration include aqueous solutions of the active preparation in water-soluble form. Additionally, suspensions of the active ingredients may be prepared as appropriate oily or water based injection suspensions. Suitable lipophilic solvents or vehicles include fatty oils such as sesame oil, or synthetic fatty acids esters such as ethyl oleate, triglycerides or liposomes. Aqueous injection suspensions may contain substances, which increase the viscosity of the suspension, such as sodium carboxymethyl cellulose, sorbitol or dextran. Optionally, the suspension may also contain suitable stabilizers or agents which increase the solubility of the active ingredients to allow for the preparation of highly concentrated solutions.

Alternatively, the active ingredient may be in powder form for constitution with a suitable vehicle, e.g., sterile, pyrogen-free water based solution, before use.

The pharmaceutical composition of the present invention may also be formulated in rectal compositions such as suppositories or retention enemas, using, e.g., conventional suppository bases such as cocoa butter or other glycerides.

Pharmaceutical compositions suitable for use in context of the present invention include compositions wherein the active ingredients are contained in an amount effective to achieve the intended purpose. More specifically, a therapeutically effective amount means an amount of active ingredients (the upregulating, stabilizing or downregulating agent or the expression vector encoding MSF-A and/or HIF-1α) effective to prevent, alleviate or ameliorate symptoms of a disorder (e.g., cancer and/or cancerous tumor or acute ischemia) or prolong the survival of the subject being treated.

Determination of a therapeutically effective amount is well within the capability of those skilled in the art, especially in light of the detailed disclosure provided herein.

For any preparation used in the methods of the invention, the therapeutically effective amount or dose can be estimated initially from in vitro and cell culture assays. For example, a dose can be formulated in animal models to achieve a desired concentration or titer. Such information can be used to more accurately determine useful doses in humans.

Toxicity and therapeutic efficacy of the active ingredients described herein can be determined by standard pharmaceutical procedures in vitro, in cell cultures or experimental animals. The data obtained from these in vitro and cell culture assays and animal studies can be used in formulating a range of dosage for use in human. The dosage may vary depending upon the dosage form employed and the route of administration utilized. The exact formulation, route of administration and dosage can be chosen by the individual physician in view of the patient's condition (See e.g., Fingl, et al., 1975, in "The Pharmacological Basis of Therapeutics", Ch. 1 p. 1).

Dosage amount and interval may be adjusted individually to provide plasma levels of the active ingredient are sufficient to prevent cancer and/or cancerous tumor or acute ischemia (minimal effective concentration, MEC). The MEC will vary for each preparation, but can be estimated from in vitro data. Dosages necessary to achieve the MEC will depend on individual characteristics and route of administration. Detection assays can be used to determine plasma concentrations.

Depending on the severity and responsiveness of the condition to be treated, dosing can be of a single or a plurality of administrations, with course of treatment lasting from several days to several weeks or until cure is effected or diminution of the disease state is achieved.

The amount of a composition to be administered will, of course, be dependent on the subject being treated, the severity of the affliction, the manner of administration, the judgment of the prescribing physician, etc.

Compositions of the present invention may, if desired, be presented in a pack or dispenser device, such as an FDA approved kit, which may contain one or more unit dosage forms containing the active ingredient. The pack may, for example, comprise metal or plastic foil, such as a blister pack. The pack or dispenser device may be accompanied by instructions for administration. The pack or dispenser may also be accommodated by a notice associated with the container in a form prescribed by a governmental agency regulating the manufacture, use or sale of pharmaceuticals, which notice is reflective of approval by the agency of the form of the compositions or human or veterinary administration. Such notice, for example, may be of labeling approved by the U.S. Food and Drug Administration for prescription drugs or of an approved product insert. Compositions comprising a preparation of the invention formulated in a compatible pharmaceutical carrier may also be prepared, placed in an appropriate container, and labeled for treatment of an indicated condition, as if further detailed above.

Thus, the teachings of the present invention can be used, for example, to treat individuals suffering from acute ischemia. Thus, an expression vector (e.g., a viral vector) including a polynucleotide sequence encoding the MSF-A and/or HIF-1α mRNA (SEQ ID NO:1 and/or 2, respectively) and the suitable promoter sequences to enable expression in heart cells is introduced into the individual via intravenous administration. Expression of such a vector in the heart is expected to upregulate and stabilize the MSF-A-HIF-1α protein complex in the heart, increase HIF-1α transcriptional activity on angiogenesis target genes and thus treat the acute ischemia. Dosage of such an expression vector should be calibrated using cell culture experiments and acute ischemia animal models. Success of treatment is preferably evaluated by determining the plasma levels of Troponin, CPK and other markers of myocardial acute ischemia and the individual general health status.

It will be appreciated, that if such a treatment is employed immediately following the first signs of acute ischemia, i.e., during or immediately following a heart attack, or stroke, it may prevent the complications associated with such a condition.

The agents described hereinabove which are capable of increasing the MSF-A-dependent HIF-1α activity and/or stabilizing an MSF-A-HIF-1α protein complex can be also used in various applications in which upregulation of angiogenesis is desired.

Thus, according to another aspect of the present invention, there is provided a method of inducing angiogenesis in a tissue. The method is effected by contacting the tissue with an agent capable of upregulating an MSF-A-dependent HIF-1α activity and/or stabilizing an MSF-A-HIF-1α protein complex to thereby induce angiogenesis in the tissue.

As used herein the term "angiogenesis" refers to the formation of new blood vessels, usually by sprouting from pre-existing blood vessels.

The term "tissue" refers to aggregate of cells having a similar structure and function and including blood vessels. Examples include, but are not limited to, brain tissue, retina, skin tissue, hepatic tissue, pancreatic tissue, bone, cartilage, connective tissue, blood tissue, muscle tissue, cardiac tissue brain tissue, vascular tissue, renal tissue, pulmunary tissue, gonadal tissue, hematopoietic tissue and fat tissue.

The tissue according to this aspect of the present invention can be part of an organism or individual (i.e., for in vivo angiogenesis), can be taken out of the organism (e.g., for ex vivo tissue repair) or can be formed ex vivo from cells derived from the organism on a scaffold or a matrix selected suitable for tissue formation.

For example, the agents according to this aspect of the present invention which are capable of upregulating an MSF-A-dependent HIF-1α activity and/or stabilizing an MSF-A-HIF-1α protein complex can be used to induce angiogenesis of a tissue. Briefly, any of the MSF-A and/or HIF-1α upregulating agents of the present invention (e.g., the polynucleotide expressing MSF-A or HIF-1α, the MSF-A or HIF-1α polypeptide or peptide, cells expressing MSF-A or HIF-1α, the compound increasing MSF-A or HIF-1α transcription, translation or stability and/or the MSF-A or HIF-1α substrate) can be provided to a tissue to thereby activate HIF-1α activity and induce angiogenesis.

Thus, the method and agents (which are capable of increasing the MSF-A-dependent HIF-1α activity) according to this aspect of the present invention can be used in vitro, to form a tissue model, ex vivo, for tissue regeneration and/or repair and in vivo for tissue regeneration and/or repair in various clinical conditions such as infarcted heart, brain lesion, spinal cord injury, ischemia and the like.

According to preferred embodiments of this aspect of the present invention, the MSF-A and/or HIF-1α upregulating agents can be attached to, added to or impregnated within a scaffold designed to enable cell growth, angiogenesis and tissue formation. Such a scaffold can be any synthetic or biodegradable scaffold known in the arts. Non-limiting examples of scaffolds which can be used to induce angiogenesis along with the agents of the present invention include the bioengineered polyglycolic acid cloth (PGAC) described in Fukuhara S., et al. (Circ. J. 69:850-7, 2005), hyaluronic acid (HA) hydrogels (Hou S, et al., 2005, J. Neurosci. Methods. June 21; Epub ahead of print), fibrin gel (Royce S M, et al., 2004, J. Biomater. Sci. Polym. Ed. 15(10): 1327-36) and the like.

The present invention also envisages identification of other anti cancer agents which are capable of preventing the formation of or dissociating the MSF-A-HIF-1α protein complex and as such may be used as anti cancer drugs.

Thus, according to another aspect of the present invention there is provided a method of identifying putative anti cancer agents.

As used herein, the phrase "anti cancer agents" refers to chemicals, antibodies, aptamers, peptides and the like which can be used to treat and prevent the growth of cancerous cells or cancerous tumors.

The method is effected by identifying agents which are capable of downregulating an MSF-A dependent HIF-1α activity, preventing the formation of or dissociating the MSF-A-HIF-1α protein complex to thereby identify the putative anti cancer agents.

As is shown in Example 1 of the Examples section which follows an MSF-A-HIF-1α protein complex used for identifying such agents (i.e., the pre-established complex) can be formed in vitro by co-transfection of cells with expression vectors containing the MSF-A (SEQ ID NO:1) and HIF-1α (SEQ ID NO:2) coding sequences.

Alternatively, peptides, which encompass the interaction site of either of the proteins may be used to generate the MSF-A-HIF-1α protein complex of this aspect of the present invention. For example, a peptide which is derived from the N-terminal part of the MSF-A protein (i.e., amino acids 1-25 as set forth in SEQ ID NO:3) along with additional amino acid sequences (as needed) can be used to form the pre-established complex.

Combinatorial chemical, nucleic acid or peptide libraries may be used to screen a plurality of agents.

Screening according to this aspect of the present invention may be effected by contacting the agents with the pre-established complex described hereinabove or with either an MSF-A or an HIF-1α. The MSF-A or the HIF-1α proteins are preferably bound to a solid support to monitor binding of the agent to the MSF-A or the HIF-1α proteins or to monitor dissociation of the pre-established complex, respectively. The solid support may be any material known to those of ordinary skill in the art to which a specific antibody which can recognize the MSF-A or the HIF-1α proteins may be attached, such as a test well in a microtiter plate, a nitrocellulose filter or another suitable membrane. Alternatively, the support may be a bead or disc, such as glass, fiberglass, latex or a plastic such as polystyrene or polyvinylchloride. Molecular immobilization on a solid support is effected using a variety of techniques known to those in the art.

A number of methods are known in the art for determining intermolecular interactions. Examples include, but are not limited to, ELISA, Biacore, Pull-down assay, immunoprecipitation and the like (see references in the Examples section which follows).

A competitive assay in which at least one of the assay component is labeled may also be employed. Labeling methods and tags are described in the references incorporated to the Examples section which follows.

It will be appreciated that when utilized along with automated equipment, the above-described method can be used to screen multiple agents both rapidly and easily.

Agents identified using the above-described methodology can be further qualified by functional assays, such as by inhibiting the transcriptional activity of a reporter gene (e.g., luciferase) as described in Example 2 of the Examples section which follows.

As is shown in FIGS. 6a-d, an immunoprecipitation experiment followed by an immunoblotting experiment demonstrated that an N-terminal truncated form of MSF-A is unable to form a protein complex with HIF-1α.

Thus, the present invention further provides a method of determining if a molecule is capable of preventing the formation of and/or dissociating an MSF-A-HIF-1α protein complex.

The method is effected by incubating the MSF-A-HIF-1α protein complex or cells harboring the MSF-A-HIF-1α protein complex with the molecule (for example, any one of the peptides set forth by SEQ ID Nos:12-4193 and 4213) and determining the presence, absence or level (amount of complexed vs. uncomplexed proteins) of the MSF-A-HIF-1α protein complex following such incubation. It will be appreciated that absence of the MSF-A-HIF-1α protein complex is indicative of the capacity of the molecule to prevent the formation of and/or dissociate the MSF-A-HIF-1α protein complex.

As is shown in the Examples section which follows, the incubation time used by the present invention to detect the presence or absence of the MSF-A-HIF-1α protein complex was in most cases 24-48 hours following transfection, or 24 hours following subjecting the cells to hypoxia or normoxia.

Thus, according to preferred embodiments incubating is effected for a time period selected from the range of 1-48 hours, more preferably, for a time period of 1-24 hours, most preferably, 1-12 hours.

The term "determining" as used herein with regard to the presence or absence of the protein complex, refers to the detection, identification or isolation of the protein complex (i.e., via immunoprecipitation and affinity columns) and the determination of the presence of both proteins (i.e., MSF-A and HIF-1α) within such a protein complex using e.g., an immunological detection method as is shown in FIGS. 3a-f and the Examples section which follows.

Immunological detection methods: The immunological detection methods used in context of the present invention are fully explained in, for example, "Using Antibodies: A Laboratory Manual" [Ed Harlow, David Lane eds., Cold Spring Harbor Laboratory Press (1999)] and those familiar with the art will be capable of implementing the various techniques summarized hereinbelow as part of the present invention. All of the immunological techniques require antibodies specific to both MSF-A and HIF-1α proteins. Such antibodies can be obtained from any commercial supplier of molecular biology reagents such as Gibco-Invitrogen Corporation (Grand Island, N.Y. USA), Sigma (St. Louis Mo., USA), Santa Cruz (Biotechnology, Inc., Santa Cruz, Calif., USA), Roche (Indianapolis, Ind., USA) and/or by using the MSF-A antibody of the present invention. Immunological detection methods suited for use as part of the present invention include, but are not limited to, radio-immunoassay (RIA), enzyme linked immunosorbent assay (ELISA), western blot, immunohistochemical analysis, and fluorescence activated cell sorting (FACS).

Radio-immunoassay (RIA): In one version, this method involves precipitation of the desired substrate, HIF-1α or MSF-A in this case and in the methods detailed hereinbelow, with a specific antibody and radiolabelled antibody binding protein (e.g., protein A labeled with $I^{125}$) immobilized on a precipitable carrier such as agarose beads. The number of counts in the precipitated pellet is proportional to the amount of substrate.

In an alternate version of the RIA, a labeled substrate and an unlabelled antibody binding protein are employed. A sample containing an unknown amount of substrate is added in varying amounts. The decrease in precipitated counts from the labeled substrate is proportional to the amount of substrate in the added sample.

Enzyme linked immunosorbent assay (ELISA): This method involves fixation of a sample (e.g., fixed cells or a proteinaceous solution) containing a protein substrate to a surface such as a well of a microtiter plate. A substrate specific antibody coupled to an enzyme is applied and allowed to bind to the substrate. Presence of the antibody is then detected and quantitated by a colorimetric reaction employing the enzyme coupled to the antibody. Enzymes commonly employed in this method include horseradish peroxidase and alkaline phosphatase. If well calibrated and within the linear range of response, the amount of substrate present in the sample is proportional to the amount of color produced. A substrate standard is generally employed to improve quantitative accuracy.

Western blot: This method involves separation of a substrate from other protein by means of an acrylamide gel followed by transfer of the substrate to a membrane (e.g., nylon or PVDF). Presence of the substrate is then detected by antibodies specific to the substrate, which are in turn detected by antibody binding reagents. Antibody binding reagents may be, for example, protein A, or other antibodies. Antibody binding reagents may be radiolabelled or enzyme linked as described hereinabove. Detection may be by autoradiography, colorimetric reaction or chemiluminescence. This method allows both quantitation of an amount of substrate and determination of its identity by a relative position on the membrane which is indicative of a migration distance in the acrylamide gel during electrophoresis.

Immunohistochemical analysis: This method involves detection of a substrate in situ in fixed cells by substrate specific antibodies. The substrate specific antibodies may be enzyme linked or linked to fluorophores. Detection is by microscopy and subjective evaluation. If enzyme linked antibodies are employed, a colorimetric reaction may be required. It will be appreciated that the presence of the MSF-A-HIF-1α complex can be detected in cells by double-labeling immunofluorescence as described in Example 3 of the Examples section which follows.

Fluorescence activated cell sorting (FACS): This method involves detection of a substrate in situ in cells by substrate specific antibodies. The substrate specific antibodies are linked to fluorophores. Detection is by means of a cell sorting machine which reads the wavelength of light emitted from each cell as it passes through a light beam. This method may employ two or more antibodies simultaneously.

According to preferred embodiments of the present invention determination of the presence or absence of the MSF-A-HIF-1α protein complex is effected by sequentially and/or simultaneously exposing the protein complex or cells expressing the protein complex to an anti-MSF-A and anti-HIF-1α antibodies.

As used herein the term "sequentially" refers the use of one antibody in one immunological detection method (i.e., immunoprecipitation or affinity column) and the use of the second antibody in the other immunological detection method (i.e., Western Blot, Eliza, FACS and the like). See for further details the methodology described in the Examples section which follows.

The term "simultaneously" as used herein refers to the use of both antibodies by the same time, using for example, double immunohistochemistry (see FIGS. 12a-c and Example 3 of the Examples section which follows).

As is mentioned before, the association of MSF-A with the HIF-1α protein upregulates HIF-1α transcriptional activity (see Example 2 of the Examples section which follows). In addition, HIF-1α over-expression is associated with a failure of anti cancer therapy [Escuin, 2004 (Supra)].

Thus, the present invention also contemplates a method of determining the prognosis of an individual having cancer.

The method is effected by determining the presence or absence of an MSF-A-HIF-1α protein complex in cancerous cells derived from the individual, wherein the presence of such a protein complex is indicative of poor prognosis of the individual.

As used herein "prognosis" refers to the probable outcome or course of a disease; the chance of recovery. Thus, individuals with poor prognosis have less chances of recovery than individuals with good prognosis.

It will be appreciated that individuals in which the MSF-A-HIF-1α protein complex is detected have relatively poor prognosis as compared with individuals lacking such a protein complex.

As used herein the term "about" refers to +10%.

Additional objects, advantages, and novel features of the present invention will become apparent to one ordinarily skilled in the art upon examination of the following examples, which are not intended to be limiting. Additionally, each of the various embodiments and aspects of the present invention as delineated hereinabove and as claimed in the claims section below finds experimental support in the following examples.

EXAMPLES

Reference is now made to the following examples, which together with the above descriptions, illustrate the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., Ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (Eds.) "Genome Analysis: A Laboratory Manual Series", Vols. 1-4, Cold Spring Harbor Laboratory Press, New York (1998); methodologies as set forth in U.S. Pat. Nos. 4,666,828; 4,683, 202; 4,801,531; 5,192,659 and 5,272,057; "Cell Biology: A Laboratory Handbook", Volumes I-III Cellis, J. E., Ed. (1994); "Culture of Animal Cells—A Manual of Basic Technique" by Freshney, Wiley-Liss, N.Y. (1994), Third Edition; "Current Protocols in Immunology" Volumes I-III Coligan J. E., Ed. (1994); Stites et al. (Eds.), "Basic and Clinical Immunology" (8th Edition), Appleton & Lange, Norwalk, Conn. (1994); Mishell and Shiigi (Eds.), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., Ed. (1984); "Nucleic Acid Hybridization" Hames, B. D., and Higgins S. J., Eds. (1985); "Transcription and Translation" Hames, B. D., and Higgins S. J., Eds. (1984); "Animal Cell Culture" Freshney, R. I., Ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Materials and Experimental Methods

Metabolic labeling of PC-3 cells—Metabolic labeling of PC-3 cells was performed using [$^{35}$S] methionine (ICN Biomedicals, Inc., CA) essentially as described in Mabjeesh, N. J. et al. (Geldanamycin induces degradation of hypoxia-inducible factor 1 alpha protein via the proteasome pathway in prostate cancer cells. Cancer Res., 62: 2478-2482, 2002).

Preparation of whole cell lysates—Cells were washed twice with ice-cold PBS, harvested whole cell extracts (WCE) were prepared by lysing the cells with 100 mM potassium phosphate (pH 7.8) and 0.2% Triton X-100 supplemented with protease and phosphatase inhibitors as described elsewhere (Mabjeesh N J et al. 2ME2 inhibits tumor growth and angiogenesis by disrupting microtubules and dysregulating HIF. Cancer Cell 2003; 3: 363-375).

Immunoblotting—Proteins (30-60 µg/lane) from WCEs were resolved by 7.5% SDS-PAGE, electro-blotted to nitrocellulose membranes and incubated with the indicated primary antibodies, followed by horseradish peroxidase-conjugated secondary antiserum (Amersham Biosciences, Piscataway, N.J.). Immunoreactivity was visualized by Amersham enhanced chemiluminescence reagent (Amersham Biosciences, Piscataway, N.J.). For sequential blotting with additional antibodies, the membranes were stripped from the first primary antibody using a restore Western blot stripping buffer (Pierce, Rockford, Ill.) and were re-probed using the second primary antibody as indicated.

Immunoprecipitation—Cells were washed twice with ice-cold PBS, lysed in 20 mM Na-HEPES, pH 7.5, 0.5% Nonidet P-40, 0.1M NaCl, 2 mM EDTA, 10% Glycerol and 2 mM DTT supplemented with protease and phosphatase inhibitors, and were subjected to immunoprecipitation using anti-HIF-1α antibody and protein G-agarose beads (Pierce, Ill.) according to the manufacturer's instructions.

Construction of the p3xFlag-HIF-1α vector—HIF-1α cDNA (GenBank accession No. NM_001530; SEQ ID NO:2) was subcloned at NotI/XbaI sites of the p3xFLAG-myc-CMV-25 vector (Sigma-Aldrich Corp., St Louis, Mo., USA) to provide Flag-tagged HIF-1α at its N-terminal using the following PCR primers:

```
forward
                                              (SEQ ID NO: 8)
5'-acgtgcggccgcgatggagggcgccggcggcgcgaacg-3'
and reverse
                                              (SEQ ID NO: 9)
5'-cagttctagattatcagttaacttgatccaaagctctgag-3'
```

Construction of the pcDNA3.1-HIF-1α expression vector—HIF-1α cDNA was cut from the p3xFlag-HIF-1α vector at the NotI/XbaI sites and pasted to the pcDNA3.1 (+) expression vector (Invitrogen Life Technologies, Carlsbad, Calif.) to obtain the untagged HIF-1α wild-type.

Construction of the MSF-A expression vector (p3xFLAG-MSF-A)—Total RNA prepared from PC-3 cells was subjected to an RT-PCR reaction using the forward [5'-GAC-TAAGCTTATGAAGAAGTCTTACTCAGGAGGCACGC-GG-ACC-3' (SEQ ID NO:4)] and reverse [5'-ACGTTCTA-GATTACTA-CATCTCTGGGGCTTCTGGCTCCTTCTC-CTCC-3' (SEQ ID NO:5)] PCR primers designed according to MSF-A cDNA sequence (GenBank Accession No AF189713, SEQ ID NO:1). The resultant MSF-A cDNA was subcloned into the p3xFLAG-myc-CMV-25 (Sigma-Aldrich Corp., St Louis, Mo., USA) at HindIII/XbaI sites to provide the FLAG sequence at the amino terminal of the recombinant protein. The sequence of the cloned MSF-A vector was validated by sequence analysis.

Construction of ΔN-MSF-A expression vector (p3xFlag-ΔN-MSF-A)—The p3xFLAG-MSF-A vector was subjected to PCR using the forward [5'-GACAAGCTTGCCT-TGAAAAGATCTTTTGAGGTC-3' (SEQ ID NO:6)] and reverse (SEQ ID NO:5)] PCR primers and the resultant N-terminal truncated MSF-A cDNA (ΔN-MSF-A; deletion of the first 25 amino acids, SEQ ID NO:7) was subcloned into the p3xFLAG-myc-CMV-25 at the HindIII/XbaI sites.

Construction of AG-MSF-A expression vector (p3xFlag-ΔG-MSF-A)—The MSF-A mutant lacking the GTP binding domain [ΔG; deletion of amino acids GQSGLGKS (SEQ ID NO:4198) which correspond to amino acids 305-312 as set forth by SEQ ID NO:3] was generated by two PCR reactions using the vector containing the wild-type MSF-A (p3xFLAG-MSF-A) as a template. In the first PCR reaction, the forward 5'-GACTAAGCTTATGAAGAAGTCTTACT-CAGGAGGCACGCGGACC-3' (SEQ ID NO:4) primer corresponding to the N-terminal and an internal reverse primer 5'-TGGATTTGAAGAGGGTGTTGATTAAGGT-GACCACCATGATGTTGAACTCG AAGCCC-3' (SEQ ID NO:4199) lacking 24 nucleotides corresponding to the GTP binding sequence (SEQ ID NO:4198). In the second reaction, the antisense sequence of SEQ ID NO:4199 was used as a forward internal primer 5'-GGGCTTCGAGTTCAACAT-CATGGTGGTCACCTTAATCAACACCCTCTTCAA ATCCA-3' (SEQ ID NO:4216) and the reverse primer was 5'-ACGTTCTAGATTACTA-CATCTCTGGGGCTTCTGGCTCCTTCTCCTCC-3' (SEQ ID NO:5) corresponding to the C-terminus of MSF-A. The overlapping two PCR products were used as a template to obtain the full-length of AG mutant of MSF-A using the external primers (SEQ ID NOs:4 and 5). The product was subcloned into p3xFlag-myc-CMV-25 vector at the HindIII and XbaI sites.

Stable transfection—PC-3 cell were seeded at 50% confluence in 100 mm-diameter dishes and grown in complete medium for overnight. Transfections were carried out with p3xFlag-CMV-myc-25 which includes a neomycin-resistance gene. Cells were transiently transfected with either the empty vector (EV; p3xFLAG-myc-CMV-25) or the vector carrying MSF-A (p3xFLAG-MSF-A). After 48 hours, the medium was replaced with fresh medium supplemented with 1 gr/ml of neomycin (G418; Sigma-Aldrich Co., Saint Louis, Mo.) and was changed every 3 days. Two to three weeks later, neomycin-resistant colonies were isolated and grown in medium supplemented with 500 mg/ml of neomycin. Cells were screened for Flag-MSF-A expression by Western blotting. To avoid clonal variation of the stably-transfected cells, 30 neomycin resistant clones of PC-3 stably transfected with the empty vector were pooled together and designated "PC-3-Neo" and 30 resistant clones stably-transfected with MSF-A were pooled together and designated as "PC-3-MSF-A".

Reporter gene assay and luminescence measurements—HRE-dependent luciferase activity was performed using the pBI-GL construct (pBI-GL V6L) containing six tandem copies of the VEGF hypoxia response element as previously described (Mabjeesh et al., 2002; Post and Van Meir, 2001). Cells were grown in 6-well plates and then transiently transfected in triplicate with a total of 1 µg DNA including 0.1 µg of the reporter plasmid, pBI-GL V6L. Duplicate sets of transfected cell-culture plates were then separated and incubated for 16 hours under either normoxic or hypoxic conditions. Luciferase enzymatic activity was measured using the commercial kit TROPIX (Bedford, Mass.) in the Galaxy luminometer (BMG Labtechnologies LUMIstar) following the manufacturer's instructions. Arbitrary Luciferase activity units were normalized to the amount of protein in each assay point.

Isolation and analysis of RNA—Total RNA was extracted from cells by using RNeasy Mini Kit (Qiagen Inc., Valencia, Calif.) according to the manufacturer's protocol. Total RNA from xenograft-derived tumors, which were frozen in liquid $N_2$ immediately after dissection, was prepared using TRI REAGENT (Sigma-Aldrich Co., Saint Louis, Mo.) following the manufacturer's instructions. One μg total RNA was reverse transcribed into cDNA using Reverse-iT $1^{st}$ Strand Synthesis Kit (ABgene, Epsom, United Kingdom) using anchored oligo dT as first strand primer. PCR was performed in 25 μl reaction mixture using ReddyMix PCR master mix (ABgene, Epsom, United Kingdom) with 0.3 μM of each primer and 50 ng template. Semi-quantitative RT-PCR was performed using M-actin as an internal control to normalize gene expression for the PCR templates. PCR cycle number was optimized for each primer set. Representative samples were run at different cycle numbers and the optimal cycle number was selected in the region of linearity between cycle number and PCR product intensity. Sequences of the PCR primers, number of cycles, annealing temperature and product size for each gene were as follow:

VEGF (GenBank Accession No. NM_00376): forward primer 5'-tcttcaagccatcctgtgtg-3' (SEQ ID NO:4200), reverse primer 5'-tctctcctatgtgctggcct-3' (SEQ ID NO:4201), 22 cycles, annealing temperature 57° C., 144 bp PCR product.

HIF-1α (GenBank Accession No. NM_001530): forward primer 5'-ggacaagtcaccacaggaca-3' (SEQ ID NO:4202), reverse primer 5'-gggagaaaatcaagtcgtgc-3' (SEQ ID NO:4203), 25 cycles, annealing temperature 56° C., 169 bp PCR product.

β-actin (GenBank Accession No. NM_001101): forward primer 5'-ctcctgagcgcaagtactcc-3' (SEQ ID NO:4204), reverse primer 5'-ctgcttgctgatccacatctg-3' (SEQ ID NO:4205), 17 cycles, annealing temperature 55° C., 86 bp PCR product.

ET-1 (GenBank Accession No. NM_001955): forward primer 5'-ccatgagaaacagcgtcaaa-3' (SEQ ID NO:4206), reverse primer 5'-agtcaggaaccagcagagga-3' (SEQ ID NO:4207), 22 cycles, annealing temperature 57° C., 213 bp PCR product.

CA-IX (GenBank Accession No. NM_001216): forward primer 5'-caaagaaggggatgaccaga-3' (SEQ ID NO:4208), reverse primer 5'-gaagtcagagggcaggagtg-3' (SEQ ID NO:4209), 26 cycles, annealing temperature 57° C., 568 bp PCR product.

Glut-1 (GenBank Accession No. NM_006516): forward primer 5'-gggcatgtgcttccagtatgt-3' (SEQ ID NO:4210), reverse primer 5'-accaggagcacagtgaagat-3' (SEQ ID NO:4211), 33 cycles, annealing temperature 57° C., 72 bp PCR product.

MSF-A (GenBank Accession No. AF189713): forward primer (SEQ ID NO:4), reverse primer (SEQ ID NO:5 or 4199), 22 cycles, annealing temperature 55° C., PCR products of 1761 bp or 940 bp, respectively.

The PCR products were visualized by UV illumination following electrophoresis through 2% agarose containing 0.5 μg/ml ethidium bromide at 50 V for 1 hour.

HIF-1α protein stability assays—Cells were plated into 6-well plates and grown to 70% confluence. The cells were subjected to either cycloheximide (CHX) treatment or to metabolic labeling and pulse chase assay. CHX was added to the cells at a final concentration of 10 μg/ml for the indicated time in the FIGS. 16a-c. Subsequently, the cells were washed and harvested for immunoblotting. Cells were metabolically labeled as previously described (Mabjeesh, N. J., et al., 2002, Cancer Res 62: 2478-2482). Briefly, the medium was changed to methionine- and cysteine-free as well as serum-free RPMI 1640 medium for 2 hours, following which the cells were labeled by incubation with methionine- and cysteine-free medium containing $^{35}S$-methionine (Amersham Biosciences Corp., Piscataway, N.J.) at a final concentration of 100 μCi/well at 37° C. for 1.5 hours. Subsequently, the radioactive medium was removed and cells were re-cultured in complete medium for the indicated times. The cells were washed twice with ice-cold PBS, lysed, and subjected to immunoprecipitation using the anti-HIF-110 antibody. Immunoprecipitates were analyzed on SDS-PAGE and visualized by autoradiography.

Immunohistochemistry with anti-CD34 and anti-Ki67—For immunohistochemical staining paraffin-embedded tissue was sectioned at 3 μm and mounted on Superfrost/plus slides (Menzel-Glaser, Braunschweig, Germany). Sections were processed by a labeled-(strept)-avidin-biotin (LAB-SA) method using a Histostain Plus Kit (Zymed, San Francisco, Calif.) and following exactly the manufacturer's instructions. Sections were pre-treated for 12 minutes at 97° C. with the Target Retrieval buffer (Zymed, San Fransisco, Calif.) at pH 6.0 using a temperature-controlled microwave (H2800 model processor, Energy Beam Sciences Inc., Apawa, Mass.). The sections were treated with 3% $H_2O_2$ for 5 minutes, followed by 10 minutes incubation with the universal blocker, Cas-Block (Zymed, San Francisco, Calif.). After blocking, sections were incubated for 30 minutes at room temperature with anti-CD34 (at a 1:50 dilution) or anti-Ki67 (at a 1:25 dilution). Slides were then washed with the TNT wash buffer (NEN, CITY, COUNTRY) and incubated for 30 minutes with species-specific biotinylated secondary antibody (1:200 dilution, Vector Laboratories, Burlingame, Calif.). A biotinylated secondary antibody was applied for 10 minutes, followed by a 10-minute incubation with peroxidase conjugated streptavidin (HRP-SA). The slides were thoroughly washed after each incubation using the Optimamax wash buffer (Biogenex, San Roman, Calif.). The immunoreaction was visualized by an HRP-based chromogen (Substrate System) including diamino-benzidine brown chromogene (Liquid DAB Substrate Kit, Zymed). The sections were then counterstained with Mayen's hematoxylin dehydrated in ascending ethanol concentration, cleared in xylene and mounted for microscopic examination. For negative controls, the exact procedure was done with the omission of either the primary or the secondary antibody. For quantitative analysis of Ki67 and CD34 staining, positive staining cells and microvessels were counted and their density expressed as the number of positive cells per total number of cells or capillaries per total section area excluding necrotic areas, respectively.

Production of sequence-directed antibodies against MSF-A protein—A peptide of 15 amino acids corresponding to the amino terminal part of MSF-A protein (amino acids 3-17; KSYSGGTRTSSGRLR; SEQ ID NO:4212) was synthesized, conjugated to a carrier protein and injected into rabbits (Convance Research Products Inc., Denver, Pa.). The sequence of the peptide was selected from the region that is not homologous to any other member within the overall septin family. The sera drawn from the rabbits were tested for MSF-A immunoreactivity using IP and Western blotting.

Immunofluorescence and confocal microscopy—Exponentially growing cells were plated on 12-mm glass coverslips (Fisher Scientific, Pittsburgh, Pa.) into 24-well plates and cells were allowed to attach overnight. The following day, cells were subjected to hypoxia for 16 hours. Cells were fixed for 10 minutes at room temperature with the PHEMO buffer (PIPES 0.068 M, HEPES 0.025 M, EGTA 0.015 M, $MgCl_2$ 0.003 M, 10% DMSO, pH 6.8) containing 3.7% formaldehyde, 0.05% glutaraldehyde, 0.5% Triton X-100. Coverslips were blocked for 10 minutes in 10% goat serum/PBS and processed for double-labeling immunofluorescence with monoclonal mouse anti-HIF-1α, and polyclonal rabbit anti-MSF-A antibodies. The secondary antibodies were Alexa Fluor 488 goat anti-mouse antibody and Rhodamine Red-X goat anti-rabbit antibodies. Coverslips were then mounted onto glass slides and examined with a Zeiss axioplasm laser scanning confocal microscope using a Zeiss×100 1.3 oil-immersion objective.

In Vitro Proliferation Assays

Cell proliferation assay with XTT reagent—For cell proliferation assay, PC-3-Neo and PC-3-MSF-A cells were seeded in 96 well-plates (1000 cells/well in 200 μLI) using a 3-bis-(2-methoxy-4-nitro-5 sulfenyl)-(2H)-tetrazolium-5-carboxanilide (XTT) kit (Biological Industries Ltd. Kibbutz Beit Haemek, Israel). Wells filled with media served as a control. On the next day, the cells were cultured either under normoxic or hypoxic conditions. XTT reagent was added at days 0, 2, 4 and 6 following the manufacturer's instructions. The absorbance of the samples was measured using a microplate reader at a wavelength of 450 nm using Elisa reader 680 (Bio-rad, Hercules, Calif.). All experiments were performed in triplicate.

Plating Efficiency assay—PC-3-Neo and PC-3-MSF-A cells were cultured in 100 mm-diameter plate (1000 cells/plate) and incubated to allow colony formation. The cultures were monitored on a daily basis and when colonies were visible (approximately after 2 weeks) cells were fixed and stained with 90% EtOH, 5% Acetic acid, 0.01% Coomassie brilliant blue (Sigma-Aldrich, Saint Louis, Mo.). Plating was done in triplicates. Colonies containing $\geq 20$ cells were counted. Plating efficiency (%) was calculated as number of colonies formed/number of cells plated×100.

Soft Agar Foci assay—The assay tests the anchorage-independent growth of the cell in soft agar. Suspensions of PC-3-Neo or PC-3-MSF-A cells in 0.22% soft agar were poured on 35 mm-diameter plate (5000 cells/plate) pre-cast with 0.5% soft agar and were cultured for 4 weeks. Colonies ($\geq 20$ cells) were counted.

Tumor models and immunohistochemistry—PC-3-Neo or PC-3-MSF-A cells ($3 \times 10^6$) were subcutaneously (s.c.) injected into the right hinds of CD1/nude mice. All procedures were performed in compliance with the Tel Aviv Sourasky Medical Center Animal Care and Use Committee and NIH guidelines. Animals were monitored for tumor development twice a week. Tumor parameters were measured with calipers, and tumor volume was calculated according to the formula: tumor volume=width$^2$×length×0.52. After 6 weeks, animals were sacrificed and tumors were excised as quickly as possible, weighed and cut into 2 pieces. One piece of tumor was fixed with 4% buffered formalin for 24 hours, embedded in Paraplast (Oxford Labware, St. Louis, Mo., USA) until immunohistochemical staining and the second piece of the tumor was immediately frozen in liquid N$_2$ and kept at −80° C. for RNA analysis.

Tumor array and dot blot analysis—An MSF-A cDNA [HindIII/EcoRI; SEQ ID NO:4214 (nucleotides 1-721 of SEQ ID NO:1)] was labeled with $\alpha^{32}$P-dCTP (Qiagen Inc., Valencia, Calif.) and used to probe the Human Matched Tumor/Normal Expression Array from Clontech Cat. #7840-1 (Mountain View, Calif.) under high stringency conditions following the instructions of the manufacturer. Washed filters were exposed to autoradiographic films. For normalization, the membrane was stripped and re-probed with a labeled β-actin probe (Ambion, Austin, Tex., USA). Dots densities were analyzed using densitometry and each MSF-A dot was normalized to its corresponding β-actin dot. The ratio between tumoral and normal expression of each pair was then calculated.

Data analysis—Experiments presented in all Figures of the present invention are representative of three or more different repetitions. Quantification of band densities was performed using the public domain NIH Image (version 1.61). Statistical analysis was performed using a one-way ANOVA test ($p<0.05$ was considered statistically significant).

Example 1

MSF-A Associates with HIF-1 Alpha In Vitro and In Vivo

Prostate cancer cells (PC-3) express increased levels of HIF-1α protein under normoxic conditions (Zhong H et al. Increased expression of hypoxia inducible factor-1alpha in rat and human prostate cancer. Cancer Res 1998; 58: 5280-5284). To identify proteins, which regulate HIF-1 transcriptional activity under aerobic/normoxic conditions, PC-3 cells were used in a set of immunoprecipitation (IP) and immunoblotting (IB) analyses, as follows.

Experimental Results

Figure 1:
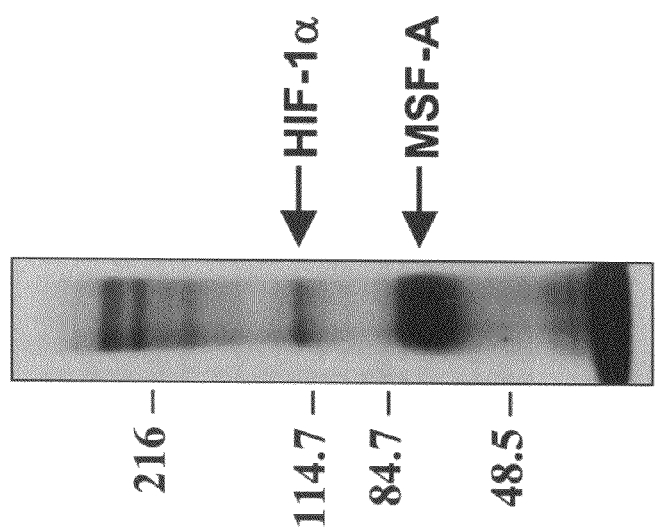

MSF-A co-immunoprecipitated with HIF-1α—PC-3 cells were metabolically labeled with [$^{35}$S]-methionine and whole cell lysates were subjected to immunoprecipitation using a purified mouse monoclonal anti-HIF-1α antibody (BD Transduction Laboratories, Lexington, Ky.). The immunoprecipitated proteins were analyzed on an SDS-PAGE and were visualized by autoradiography. As is shown in FIG. 1, several protein bands were detected in the immunoprecipitate protein mixture. Of these proteins, a 70 kDa protein, displayed a strong band signal (FIG. 1), suggesting strong association with the HIF-1α protein. Another relatively strong band, of 120 kDa, corresponded to the HIF-1α protein. To determine the identity of the 70-kDa protein, a larger scale of a non-radioactive PC-3 cell preparation was subjected to silver staining, following which the 70-kDa band was eluted and its amino acid sequence was analyzed using MALDI-TOF-MS. The protein was identified as a myeloid/lymphoid leukemia septin-like fusion protein A (MSF-A, GenBank Accession No. AAF23374, SEQ ID NO:3). This septin-like protein was first identified as part of a fusion protein with MLL in a therapy-induced acute myeloid leukemia patient [Osaka M, Rowley J D, Zeleznik-Le N J. MSF (MLL septin-like fusion), a fusion partner gene of MLL, in a therapy-related acute myeloid leukemia with a t(11; 17)(q23; q25). Proc Natl Acad Sci USA 1999; 96: 6428-6433]. The exact function and cellular localization of MSF-A protein have not been elucidated. Recent studies suggested novel functions for septins in vesicle trafficking, cytokenesis and oncogenesis (Kartmann B, Roth D. Novel roles for mammalian septins: from vesicle trafficking to oncogenesis. J Cell Sci 2001; 114: 839-844).

Figure 2:
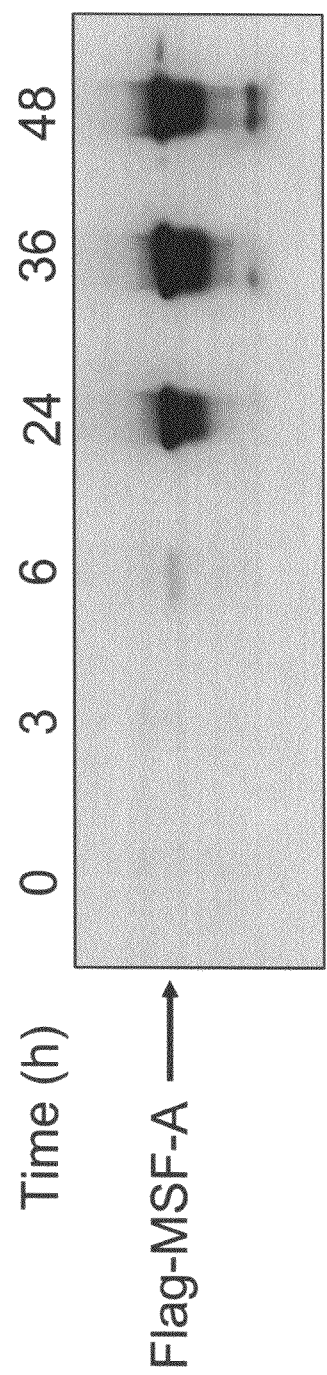

Confirmation of MSF-A/HIF-1α interaction—Since the MSF-A protein has not been previously characterized, antibodies capable of recognizing this protein have not been available prior to the present study. In order to confirm the interaction between MSF-A and HIF-1α, an in vitro system comprising of co-transfected cells was established. In a preliminary experiment, PC-3 or HEK 293 cells were transiently transfected with the p3xFlag-MSF-A expression vector and cell lysates of transfected cells were subjected to Western Blot analysis using an anti-Flag antibody (Sigma-Aldrich Corp., St Louis, Mo., USA). As is shown in FIG. 2, a time-dependent expression of the recombinant 70-kDa FLAG-tagged protein was observed.

To confirm the interaction between the HIF-1α and the MSF-A proteins, HEK 293 cells were transiently co-transfected with the p3xFlag-MSF-A and the pcDNA3.1-HIF-1α vectors, and were grown for 24 hours under normoxic conditions (i.e., conditions of 20% oxygen), following which whole cell extracts (WCE) were subjected to co-immunoprecipitation (IP) using anti-FLAG or anti-HIF-1α antibodies. Following IP, the proteins were subjected to SDS-PAGE and immunoblotting (IB) using the counterpart antibody. As is shown in FIGS. 3a-d, following transfection with both expression vectors (i.e., pcDNA3.1-HIF-1α and p3xFlag-MSF-A) immunoprecipitates generated using either the anti-HIF-1α antibody or the anti-Flag antibody included the reciprocal proteins, i.e., the Flag-MSF-A or HIF-1α proteins, respectively. These findings clearly demonstrate a strong association between the two recombinant proteins (i.e., MSF-A and HIF-1α) in vitro. On the other hand, as is further shown in FIGS. 3e-f, the Flag antibody (which represents the MSF-A protein) failed to co-immunoprecipitate HIF-1β protein.

To further confirm the HIF-1α/MSF-A interaction, HEK 293 cells were transiently co-transfected with both the p3xFlag-MSF-A and p3xFlag-HIF-1α vectors. Twenty-four hours following transfection, cells were grown under normoxia (i.e., 20% oxygen) or hypoxia (i.e., 1% oxygen) for additional 24 hours, following which anti-HIF-1 antibody was used in IP experiments. IP samples were further subjected to Western Blot analysis using either anti-HIF-1α antibody or anti-Flag antibody. As is shown in FIGS. 4a-b, the anti-HIF-110 antibody was capable of precipitating both Flag-HIF-1 and Flag-MSF-A proteins under normoxia conditions, and to a lesser extent under hypoxia conditions.

The p300 co-activator is associated with HIF-1α and MSF-A proteins—To test the hypothesis that proteins, which are known to interact with the HIF-1α protein, such as the co-activator p300, are associated with MSF-A and HIF-1α, cells were co-transfected with the pcDNA3.1-HIF-1α and the p3xFlag-MSF-A expression vectors and IP experiments were performed using either anti-FLAG or anti-HIF-1α antibodies. As shown in FIGS. 5a-c, while the anti-HIF-1α antibody was capable of precipitating the p300 protein in both cells co-transfected with the pcDNA3.1-HIF-1α and the p3xFlag-cmv-25 expression vector alone and cells co-transfected with the pcDNA3.1-HIF-1α and the p3xFlag-MSF-A vectors, the anti-Flag antibody was capable of precipitating the p300 protein only in cells that were co-transfected with the pcDNA3.1-HIF-1α and the p3xFlag-MSF-A vectors. These results demonstrate that the MSF-A protein interacts with the HIF-1α protein complex.

Altogether, these results demonstrate that MSF-A strongly associates with HIF-1α or HIF-1α complexes.

Example 2

MSF-A Upregulates HIF-1 Transcriptional Activity

To investigate the effect of MSF-A binding on HIF-1α function, the transcriptional activity of the HIF-1 complex was determined using a reporter gene assay as previously described (Mabjeesh N J et al. 2ME2 inhibits tumor growth and angiogenesis by disrupting microtubules and dysregulating HIF. Cancer Cell 2003; 3: 363-375).

Experimental Results

MSF-A overexpression upregulates HIF-1 transcriptional activity—The effect of MSF-A on HIF-1α transcriptional activity was determined in PC-3 cells which were transiently co-transfected with a reporter plasmid containing the luciferase gene under the control of hypoxia response element (HRE) from the VEGF promoter (Post, D. E. and Van Meir, E. G. Generation of bidirectional hypoxia/HIF-responsive expression vectors to target gene expression to hypoxic cells. Gene Ther., 8: 1801-1807, 2001) and with either the p3xFlag-MSF-A vector or the expression vector alone (p3xFlag-cmv-25). Following transfection, cells were grown under normoxia or exposed to hypoxia. In cells co-transfected with the luciferase reporter plasmid and the expression vector alone, hypoxia induced luciferase activity by more than 15-fold as compared to normoxia. However, in cells co-transfected with the luciferase reporter plasmid and the MSF-A vector (p3xFlag-MSF-A), hypoxia induced luciferase activity by 50-fold as compared to normoxia (FIG. 6). Similar results were obtained when HEK 293 cells were transfected with the same vectors (not shown).

These results demonstrate that MSF-A over-expression enhances HIF-1 transcriptional activity on target genes containing the HRE sequence. Thus, MSF-A upregulates the endogenous transcriptional activity of HIF-1α.

Example 3

Association of ΔN-MSF-A with HIF-1α Results in Inhibition of HIF-1α Transcriptional Activity Members of the evolutionarily conserved septin family of genes have a well-conserved GTP binding domain and possess a GTPase activity. SEPT9 has been shown to have a complex genomic architecture, such that up to 15 different isoforms are possible by the shuffling of five alternate N-termini and three alternate C-termini. The MSF-A protein exhibits sequence homology with other members of the MSF superfamily except for the first 25 amino acids at the N-terminal part (Kartmann B, Roth D. Novel roles for mammalian septins: from vesicle trafficking to oncogenesis. J Cell Sci 2001; 114: 839-844).

To investigate the role of the unique N-terminal sequence of MSF-A or the common GTP-binding domain of MSF-A in the association and the activation of HIF-1α (i.e., transcriptional activation of other genes), constructs of the ΔN-MSF-A (lacking the N-terminus) and ΔG-MSF-A (lacking the GTP binding site) were prepared and transiently expressed in cells.

Experimental Results

The activation of HIF-1α by MSF-A is dependent on the intact N-terminus of MSF-A protein and does not require the GTP binding domain—As is shown in FIG. 7, while the expression of wild-type (WT) MSF-A induced HIF-1α activity (as detected by the luciferase reporter gene), the expression of increasing amounts of the ΔN mutant of MSF-A (p3xFlag-ΔN-MSF-A) induced a dose-dependent inhibition of HIF-1α transcriptional activity.

These results demonstrate the use of the ΔN-MSF-A polypeptide (SEQ ID NO:10), or a polynucleotide encoding same (e.g., a polynucleotide set forth by SEQ On the other hand, the expression of the ΔG mutant of MSF-A had no significant effect on HIF-1α activity (FIG. 8). Further IP experiments showed that both the ΔN-MSF-A and ΔG-MSF-A protein products are capable of binding the HIF-1α protein (FIGS. 9a-c).

Altogether, these results indicate that the protein-protein association between MSF-A and HIF-1α is not sufficient to activate HIF-1α transcriptional activity and that full activation of HIF-1α by MSF-A requires both, the GTP binding site and the intact N-terminus of MSF-A.

Example 4

MSF-A Over-Expression Induces Cell Proliferation and Colony Formation

To further understand the mechanisms involved in upregulation of HIF-1α activity via the association with MSF-A and to understand the role of MSF-A in cancer cells, PC-3 cells were stably transfected with MSF-A (using the p3xFLAG-MSF-A vector) and neomycin resistant clones were obtained.

Experimental Results

MSF-A stable PC-3 transfectants express MSF-A to various extents and exhibit increase HIF-1α transcriptional activity—The expression level of both recombinant MSF-A and endogenous HIF-1α were analyzed using Western Blot analyses. As is shown in FIG. 10a, using the anti-Flag antibody various extents of expression levels were observed in the different MSF-A transfectants. In addition, the HRE-reporter gene assay showed that MSF-A stably expressing cells exhibit increased HIF-1 transcriptional activity (FIG. 10b). As an internal control, cells were co-transfected with both Rinella SV40-Luciferase and the firefly HRE-Luciferase and were subjected to dual Luciferase assay. There were no changes in Rinella SV40-Luciferase activity under hypoxia or between the different clones compared to empty vector control or parental PC-3 cells (data not shown).

MSF-A increases the expression of HIF-downstream genes—To avoid clonal variation of MSF-A over-expressing cells, 30 neomycin resistant clones from each expression vector were pooled [i.e., EV-transfected (designated PC-3 Neo) and MSF-A-transfected (PC-3-MSF-A)] and the pooled cells were tested for HIF-1 transcriptional activity. As is shown in FIG. 11, PC-3-MSF-A cells exhibited a significant increase in HIF-1 transcriptional activity (tested by the luciferase assay) as compared with PC-3-Neo cells. To further demonstrate the effect of MSF-A on HIF-1 target genes, semi-quantitative RT-PCR analyses were performed. Briefly, total RNA was prepared from both PC-3-Neo and PC-3-MSF-A pooled cells and RT-PCR was employed using specific primers for VEGF (SEQ ID NOs:4200 and 4201), HIF-1α (SEQ ID NOs:4202 and 4203), β-actin (SEQ ID NOs: 4204 and 4205), ET-1 (SEQ ID NOs:4206 and 4207), CA-IX (SEQ ID NOs:4208 and 4209) and Glut1 (SEQ ID NOs:4210- and 4211) (FIGS. 12a-f). These RT-PCR analyses demonstrated that while the HIF-1α mRNA level was unchanged in both PC-3-MSF-A and PC-3-Neo cells (FIG. 12e), the mRNA levels of the angiogenic factor VEGF were significantly higher in PC-3-MSF-A cells than in PC-3-Neo cells (FIG. 12a). Other HIF-1 target genes including Glut1 (FIG. 12b), CA-IX (FIG. 12d) and ET-1 (FIG. 12c) were also upregulated to various extents in PC-3-MSF-A cells.

MSF-A increases cell proliferation and colony formation—To test the effect of MSF-A on cell proliferation, the XTT assay was employed on PC-3-MSF-A and PC-3-Neo cells. As is shown in FIG. 13, under both normoxia and hypoxia, the proliferation rate of PC-3-MSF-A cells was higher to a greater extent than the proliferation rate of PC-3-Neo cells. In addition, when grown in soft agar, PC-3-MSF-A cells formed significantly more colonies, each exhibiting a larger size as compared with PC-3-Neo cells grown (FIGS. 14a-g). Moreover, PC-3-MSF-A cells also showed higher plating efficiency (49.3%) as compared to PC-3-Neo cells (16.8%)(p<0.001).

Altogether, these results demonstrate that stable over-expression of MSF-A in PC-3 cells enhances proliferation and upregulates HIF-1 target genes in vitro.

Example 5

MSF-A Affects HIF-1α Stabilization

To elucidate the mechanism by which MSF-A involves with HIF-1 activity, the effects of MSF-A expression on HIF-1α protein stability was examined. As shown in FIG. 12e, MSF-A expression does alter HIF-1α mRNA levels. The present inventor hypothesized that MSF-A affects HIF-1α activity by modulating HIF-1α post-transcriptional/translational events. To this end, PC-3 stably transfected cells were employed under normoxia or hypoxia and the effect on HIF-1α ubiquitination was studied.

Experimental Results

MSF-A stabilizes HIF-1α protein by preventing its ubiquitination—The hypoxic induction of HIF-1α was studied at shorter rate limiting time periods rather than at times enabling to reach steady state levels. After 4 hours of exposure to hypoxia, the levels of HIF-1α protein expressed in PC-3-MSF-A cells was significantly higher than in PC-3-Neo cells (FIG. 15a-b). As is shown in FIGS. 15a-b, the differences in HIF-1α expression levels were dependent on the time of hypoxia induction. While the level of HIF-1α was higher in PC-3-MSF-A cells after 4 hours of hypoxia, similar levels of HIF-1α were obtained in PC-3-Neo and PC-3-MSF-A cells after 8 hours of hypoxia induction (FIGS. 15a-b). Therefore, the effect of MSF-A on HIF-1α protein stability was further examined using the protein translation inhibitor cycloheximide (CHX) (FIGS. 16a-c) and a pulse-chase assay (FIGS. 17a-b). In the presence of CHX new protein synthesis is inhibited, thus HIF-1α levels would predominantly reflect the degradation process of HIF-1α protein. PC-3-Neo and PC-3-MSF-A cells were exposed to CHX for various incubation periods (between 0-45 minutes) and HIF-1α protein levels were analyzed by Western blot analysis and normalized to those of α-tubulin. Within 20 minutes of exposure to CHX, HIF-1α protein levels from PC-3-Neo cells were decreased to about 50% (FIGS. 16a-c). Although the intensity of the HIF-1α signal is different at the zero time-point, the degradation rate of HIF-1α protein was faster in PC-3-Neo than in PC-3-MSF-A cells (FIGS. 16a-c). This was further confirmed when cells were labeled with $^{35}$S-methionine and pulse-chased, after which HIF-1α protein levels were analyzed. The half-life of HIF-1α protein from PC-3-Neo cells was around 25 minutes compared to 45 minutes in PC-3-MSF-A cells (FIGS. 17a-b). As is further shown by the slope of the two curves, the rates of HIF-1α protein loss were slower in PC-3-MSF-A cells than in PC-3-Neo cells (FIG. 17b).

The pattern of HIF-1α immunoreactive bands in different MSF-A stable clones was examined under hypoxia (where degradation does not take place). As is shown in FIGS. 18a-b, the various clones exhibited differences in the higher molecular weight bands of HIF-1α protein which likely reflect ubiquitinated- and polyubiquitinated-HIF-1α (Ub-HIF-1α) species. The pattern of HIF-1α ubiquitination was inversely correlated with the levels of MSF-A protein expression (FIG. 18b). These results demonstrate that over-expression of MSF-A reduced HIF-1α ubiquitination species (i.e., the rate of degradation). These results suggest that the increase transcriptional activity of HIF-1α which was induced by over-expression of MSF-A is likely to be a result of stabilization of the HIF-1 protein by the MSF-A protein.

To study the ubiquitination of the endogenous HIF-1α in cells over-expressing MSF-A protein, the proteasome inhibitor MG-132 was used. Under these conditions HIF-1α is subjected to ubiquitination but can not be degraded through the proteasome. As is shown in FIGS. 19a-b, increasing doses of MG-132 induced the expression of HIF-1α and Ub-HIF-1α in PC-3-Neo cells. On the other hand, the pattern of Ub-HIF-1α levels in PC-3-MSF-A cells was less intense and exhibited lower molecular weight species (FIG. 19a). To confirm the ubiquitination forms of HIF-1α, PC-3-Neo and PC-3-MSF-A were treated with MG-132 and subjected to IP with HIF-1α antibody. Immunoprecipitates were immunoblotted in parallel with either HIF-1α (FIG. 20a) or ubiquitin (FIG. 20b) antibodies. Again, the levels of Ub-HIF-1α protein were lower in PC-3-MSF-A cells than in PC-3-Neo cells (FIG. 20a).

Altogether, these results demonstrate that the activation of HIF-1 by MSF-A is mediated through HIF-1α protein stabilization. MSF-A protein interacts with HIF-lot protein under normoxic conditions to modulate its ubiquitination and thus) escaping proteasomal degradation.

Example 6

Preparation and Characterization of MSF-A Antibodies

To further understand MSF-A role in the MSF-A-HIF-1α complex, MSF-A specific antibodies were generated and employed in Western Blot and fluorescence immunohistochemistry, as follows.

Experimental Results

Characterization of an MSF-A antibody—Following immunization with the N-terminal MSF-A peptide, sera was drawn from the immunized rabbits and was tested on whole cell extracts prepared from PC-3 cells which were stably transfected with either the expression vector alone or the MSF-A vector (p3xFLAG-MSF-A). As is shown in FIGS. 10a-c, while the anti-Flag antibody recognized the typical 70-kDa band only in MSF-A transfected cells (FIG. 21a), the immune serum recognized a 70 kDa band in cells transfected with the expression vector alone or in cells transfected with the MSF-A expression vector (FIG. 21c). In addition, as is further shown in FIG. 21c, the immune serum recognized a slightly higher molecular weight band in MSF-A transfected cells, but not in cells transfected with the expression vector alone. The higher molecular weight band represents the Flag-tagged MSF-A in MSF-A transfected cells. Noteworthy, the preimmune serum which was diluted to the same extent (i.e., 1:500), revealed no binding signal (FIG. 21b).

Confirmation of MSF-A antibody specificity—To further characterize the new anti-MSF-A antibody (i.e., the immune serum), anti-Flag immunoprecipitates, which were prepared from cells transfected with the p3xFLAG-MSF-A vector, were subjected to immunoblotting using the new anti-MSF-A antibody. The immune serum (i.e., the new anti-MSF-A antibody) was capable of recognizing the typically immunoprecipitated Flag-MSF-A protein (FIGS. 22a-d). Flag-MSF-A was not recognized by other antibodies tested (data not shown).

Thus, these results demonstrate the generation of a new anti-MSF-A antibody, which is capable of specifically interacting with the 70-kDa MSF-A protein using Western Blot.

Example 7

MSF-A and HIF-1 Alpha Co-Localize at the Cell Nuclei

To determine the localization of MSF-A, biochemical fractionation and laser scanning confocal microscopy (LSCM) were employed, as follows.

Experimental Results

MSF-A is expressed in the nuclear fraction of a variety of cancerous cell lines—To identify the cellular localization of MSF-A, cytosolic and nuclear extracts were prepared from CL-1 and PC-3 cells which were grown under normoxia or hypoxia for overnight. The nuclear and cytosolic fractions of the cells were subjected to Western Blot analysis using the anti-HIF-1α antibody following by the anti-MSF-A antibody (i.e., the immune serum). As is shown in FIG. 23a, in both CL-1 and PC-3 cells upon hypoxic exposure HIF-1α protein was localized and accumulated in the nuclear fraction. On the other hand, MSF-A was more predominantly localized in the nuclear fraction without any significant change in its levels after hypoxia (FIG. 23b). A slight increase in the expression level of MSF-A protein was noted following hypoxia (FIG. 23b). On the other hand, there was no significant difference in the expression level of α-tubulin between the nuclear and cytosolic fractions (FIG. 23c).

To further confirm the nuclear localization of MSF-A, PC3 cells were grown under normoxia or hypoxia for 24 hours, following which they were subjected to MSF-A immunohistochemistry and laser scanning confocal microscopy (LSCM). As is shown in FIGS. 24a-d, the MSF-A staining was predominantly in the nucleus. Further confirmation of the nuclear localization of MSF-A was obtained using anti-MSF-A/anti-HIF-1α double immunohistochemistry. As is shown in FIGS. 25a-f, MSF-A and HIF-1α co-localize to the cell nucleus. HIF-1 was barely detectable under normoxic conditions but accumulated in the nucleus after exposure to hypoxia (FIGS. 25a-b, green staining) while MSF-A was detected in the nucleus under both conditions, normoxia and hypoxia (FIGS. 25c-d, red staining). Overlay of both staining showed co-localization of HIF-1α with MSF-A in the nucleus (FIGS. 25e-f). Nuclear localization of MSF-A was further confirmed by double-labeling with DAPI (data not shown). The results are consistent with the predicted sequence analysis of MSF-A protein that contains a bipartite nuclear targeting sequence at amino acids 2-18 as set forth in SEQ ID NO:3.

Thus, these results demonstrate that MSF-A is a nuclear protein which associates and co-localizes with HIF-1α.

Evidence for HIF-1α/MSF-A interaction in vivo—To further confirm that the association of MSF-A with HIF-1α also occurs in vivo, prostate cancer PC-3 and CL-1 cells, which express substantial levels of the HIF-1α protein under normoxic conditions were used in an IP-IB experiment. PC-3 or CL-1 cells were grown under normoxia or hypoxia and whole cell extracts were then subjected to co-immunoprecipitation using the anti-HIF-1α antibody. The immunoprecipitates were then subjected to Western Blot analysis using either the anti-HIF-1α or the anti-MSF-A antibody. As is shown in FIGS. 26a-c, under normoxic conditions, the anti-HIF-1α antibody was capable of immunoprecipitating both HIF-1α and MSF-A proteins. Under hypoxia, although there was a higher amount of HIF-1α protein within the immunoprecipitate its interaction with MSF-A protein was much weaker as demonstrated in two different cell lines. Thus, under hypoxic conditions, MSF-A dissociates from HIF-1α. These results are in good agreement with the results observed with 293 transfected cells (see FIGS. 3a-f for comparison). FIG. 27 depicts one suggested model for MSF-A and HIF-1α interaction under normoxia and hypoxia.

Altogether, these results demonstrate that while under normoxia conditions MSF-A associates with HIF-1α, and under hypoxia conditions MSF-A dissociates from HIF-1α. Thus, the interaction between endogenous HIF-1α and MSF-A protein is $O_2$-dependent.

Example 8

The Effects of MSF-A On HIF-1, Tumor Growth and Angiogenesis In Vivo

The effects of MSF-A on HIF-1, tumor growth and angiogenesis in vivo. To examine the effect of MSF-A on tumor growth, subcutaneous xenograft mouse tumor models were induced by the PC-3-MSF-A and PC-3-Neo cells.

Experimental Results

Figure 31D:
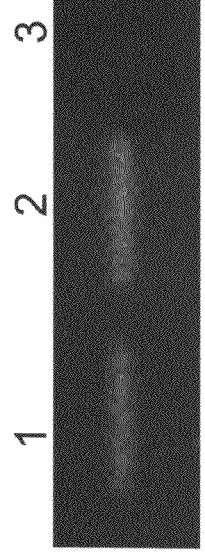
Figure 31E:
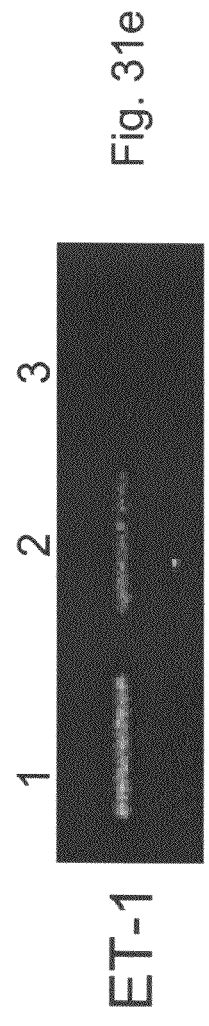
Figure 31F:
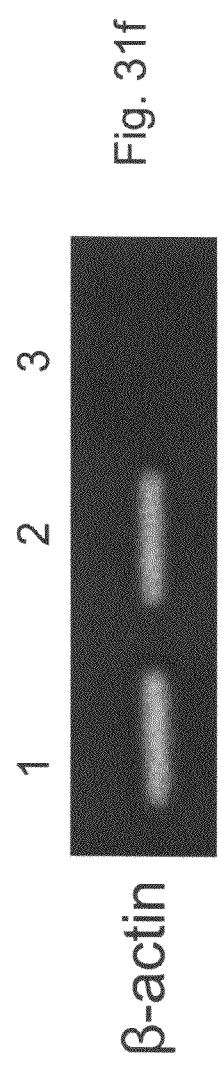

In this xenograft model, tumors derived from PC-3-MSF-A cells appeared earlier and exhibited increased mean volume (about 2-fold) compared to tumors derived from PC-3-Neo cells (FIG. 28). Although the difference in tumor volume was not statistically significant, the mean weight of PC-3-MSF-A tumors was significantly heavier than the wild-type tumors (FIG. 29). Most importantly, the phenotype of the tumors was strikingly different. Macroscopic and histological examination showed that PC-3-MSF-A tumors were more pleomorphic, aggressive and invasive, and there were only scattered small areas of necrosis, whereas a large area of central necrosis was observed in PC-3-Neo cell derived xenografts (not shown). It was also found that MSF-A over-expression significantly increased intratumoral cell proliferation and vascular density (FIGS. 30a-h). RT-PCR analysis of RNA derived from the tumors showed that the expression level of selected HIF-target genes, including VEGF and CA-IX, were elevated in PC-3-MSF-A tumors compared to PC-3-Neo tumors (FIGS. 31a-f). As a control, it is shown that PC-3-MSF-A tumor cells still express higher levels of MSF-A mRNA (FIG. 31a). Collectively, the in vitro and in vivo data indicate that MSF-A affects HIF-1 transcriptional activation, cell proliferation and tumor angiogenesis.

Example 9

MSF-A Expression in Common Human Tumors

Since under normal oxygen conditions HIF is induced by a number of oncogenes (e.g., AKT, Src, Ras), and since MSF-A was found to upregulate HIF-1α expression in vitro, the present inventor has hypothesized that MSF-A is involved in HIF-1α expression in cancerous cells. To investigate whether MSF-A is expressed in cancerous cells, whole cells extracts prepared from various cancerous cell lines were subjected to Western Blot using the new anti-MSF-A antibody (i.e., the immune serum).

Experimental Results

To examine the expression level of MSF-A in common human cancers, an expression array with matched tumor/normal cDNAs from 68 tumors and corresponding normal tissues from individual patients was employed. The array was hybridized with a probe (SEQ ID NO:4214) which reacts with all variants of SEPT9 including MSF-A. For normalization, the array was re-probed with a β-actin control probe (Ambion, Austin, Tx, USA), quantified and analyzed for comparison between normal versus tumor expression profile. As shown in FIG. 32a, strikingly SEPT9 gene was significantly over-expressed in ovarian tumor samples compared to other samples tested. Interestingly, a lesser degree of SEPT9 over-expression was observed among samples of other female reproductive system including breast and uterus (FIG. 32a). On the other hand, there was almost no change noticed in expression level samples from renal, prostate or gastrointestinal tract tumors (FIG. 32a).

To specifically follow the expression level of MSF-A, the RT-PCR analysis was extended in prostate cancer where it was originally found to interact with HIF-1α. RNA samples from various prostate cell lines and xenografts exhibited higher expression level of MSF-A mRNA in prostate cancer samples compared to those of RNA derived from normal prostate tissue (FIGS. 32b-d).

Analysis and Discussion

In the present study, a novel regulatory pathway was identified in which MSF-A, a member of the mammalian septin gene family affects tumorigenesis through, at least in part, the activation of the HIF-dependent response system. These results show that MSF-A protein directly interacts with HIF-1α but not with HIF-1β. Overexpression of MSF-A leads to activation of HIF-1 and upregulation HIF-downstream genes, in vitro and in vivo. Most importantly, the findings of the present study demonstrate that MSF-A promotes proliferation, tumor growth and vascularization.

HIF-1 is a master regulator of the hypoxic response pathway not only in physiological processes but also in pathophysiological states such as ischemia and cancer (Maxwell and Ratcliffe, 2002; Semenza, 2003; Wenger, 2002). Apart from the relatively well-characterized mechanisms of hypoxic HIF-1α subunit stabilization, many growth factors and cytokines are known to stabilize HIF-1α under normoxic conditions. Despite this great diversity, most of these growth factors might stabilize HIF-1α via common cellular kinase pathways including PI-3K and MAPK pathways, activated by cell type-specific receptors (Wenger, 2002). However, so far it is not completely understood how HIF-1α is stabilized in cancer cells under "normoxic" conditions. The importance and potential therapeutic benefits of the HIF pathway have driven the search for new regulatory components. To that end, new candidates which affect the HIF pathway were searched for. Co-immunoprecipitation experiments revealed an interaction between MSF-A and HIF-1α. MSF-A is a splice variant of the SEPT9 of the mammalian septin gene family (Macara et al., 2002) and was first found as a fusion partner gene of MLL in a case of therapy-related acute myeloid leukemia with a t(11,17)(q23; q25) translocation (Osaka et al., 1999; Taki, Ohnishi, Shinohara, Sako, Bessho, Yanagisawa and Hayashi, 1999). Septins were originally discovered in yeast and found to be involved in diverse cellular processes, including cytokinesis, vesicle trafficking, apoptosis and maintenance of cell polarity (Hall and Russell, 2004). The family of human septins shows considerable homology in the core GTP-binding domain, but divergence in the N and C terminals (Hall and Russell, 2004; Kartmann and Roth, 2001). While most of the available data on the biology of septins are derived from yeast, little is known on the physiological and the pathophysiological significance of septins in mammals. A number of evidences suggest a role of septins in oncogenesis. Some of septin genes (SEPT5, 6, 9 & 11) are involved in chromosomal translocations in myeloid leukemias with the formation of chimeric MLL fusion proteins (Hall and Russell, 2004). Second, it was found recently that SEPT9 is altered in ovarian cancer (Burrows, Chanduloy, McIlhatton, Nagar, Yeates, Donaghy, Price, Godwin, Johnston and Russell, 2003) consistent with the results of the present study and that SEPT9 is amplified and over-expressed in breast cancer (Montagna, Lyu, Hunter, Lukes, Lowther, Reppert, Hissong, Weaver and Ried, 2003). Very recently, Scott et al. has reported a meticulous analysis of SEPT9 expression in a wide range of human tumors (Scott et al., 2005). SEPT9 was found to be over-expressed in breast, CNS, endometrium, kidney, liver, lung, lymphoid, esophagus, ovary, pancreas, skin, soft tissue and thyroid (Scott et al., 2005). In this study MSF-A was found to be specifically upregulated in prostate cancer cell lines and xenografts. Interestingly, HIF-1α overexpression is also observed in the majority of human cancers (Zhong, De Marzo, Laughner, Lim, Hilton, Zagzag, Buechler, Isaacs, Semenza and Simons, 1999). Since in most cancers the mechanisms of how HIF-1α is over-expressed are yet not known while VHL is not mutated, these data support the hypothesis that the interaction between these two cellular processes may have a role in tumor progression in certain cancers.

MSF-A expression augments the activity of HIF-1 and induces higher proliferation rates both, under normoxia and hypoxia as well as in vitro and in vivo. Furthermore, MSF-A affects the pattern of tumor necrosis with overall increased vascularity within tumors. This is the first observation that a septin protein has effects on tumor angiogenesis.

A number of septins have been shown to bind and hydrolyze guanine nucleotide. However, the role of GTP binding and hydrolysis in septin function has not been fully elucidated (Field, al-Awar, Rosenblatt, Wong, Alberts and Mitchison, 1996; Gladfelter, Bose, Zyla, Bardes and Lew, 2002; Mendoza, Hyman and Glotzer, 2002; Robertson, Church, Nagar, Price, Hall and Russell, 2004; Versele and Thorner, 2004). Deletion of the GTP binding domain in MSF-A, led to no change in HIF-1 activity. There was neither activation nor inhibition of HIF-1 function while the mutant lacking the GTP binding site still has the ability to interact with HIF-1α protein. On the other hand, deletion of the most variable N-terminal domain of MSF-A exhibited dominant negative effect on HIF transcriptional activity and still has been bound to HIF-1α. These results indicate that binding of MSF-A to HIF-1α is not sufficient to activate the HIF complex but requires binding and/or hydrolysis of GTP upon MSF-A as well as intact N-terminal. It was shown previously that Rac1 of the small GTPase Rho family is activated in response to hypoxia and is required for the induction of HIF-1α protein expression and transcriptional activity in hypoxic cells (Hirota and Semenza, 2001). Very recently, Nagata and Inagaki have identified a Rho-guanine nucleotide exchange factor (GEF) as a binding partner for MSF-A, describing the first link between septins and Rho signaling (Nagata and Inagaki, 2005). It is reasonable to speculate that the activation of HIF-1 by Rho could be mediated through interactions involving MSF-A.

Mechanistically, these data show that MSF-A affects HIF-1α protein at the posttranslational level through stabilizing the protein and preventing its ubiquitination. Although the interaction between HIF-1α and MSF-A was predominantly under normoxia, the hypoxic induction of HIF-1 was also increased with overexpression of MSF-A. It is not clear yet whether MSF-A inhibits HIF-1α ubiquitination by preventing its proline hydroxylation or by modulating VHL E3-ligase activity. Further studies are necessary to elucidate the exact mechanism by which MSF-A stabilizes HIF-1α.

The interactions between HIF-1α and MSF-A, in addition to their colocalization, and the functional activation of HIF-1 by MSF-A may represent the role of SEPT9 function in tumorigenesis.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention.

REFERENCES

Additional References are Cited in Text

Bardos, J. I., and Ashcroft, M. (2004). Hypoxia-inducible factor-1 and oncogenic signalling. Bioessays 26, 262-269.

Brahimi-Horn, M. C., and Pouyssegur, J. (2005). The hypoxia-inducible factor and tumor progression along the angiogenic pathway. Int Rev Cytol 242, 157-213.

Bruick, R. K., and McKnight, S. L. (2001). A conserved family of prolyl-4-hydroxylases that modify HIF. Science 294, 1337-1340.

Burrows, J. F., Chanduloy, S., McIlhatton, M. A., Nagar, H., Yeates, K., Donaghy, P., Price, J., Godwin, A. K., Johnston, P. G., and Russell, S. E. (2003). Altered expression of the septin gene, SEPT9, in ovarian neoplasia. J Pathol 201, 581-588.

Carmeliet, P., Dor, Y., Herbert, J. M., Fukumura, D., Brusselmans, K., Dewerchin, M., Neeman, M., Bono, F., Abramovitch, R., Maxwell, P., et al. (1998). Role of HIF-1alpha in hypoxia-mediated apoptosis, cell proliferation and tumour angiogenesis. Nature 394, 485-490.

Epstein, A. C., Gleadle, J. M., McNeill, L. A., Hewitson, K. S., O'Rourke, J., Mole, D. R., Mukherji, M., Metzen, E., Wilson, M. I., Dhanda, A., et al. (2001). C. elegans EGL-9 and mammalian homologs define a family of dioxygenases that regulate HIF by prolyl hydroxylation. Cell 107, 43-54.

Field, C. M., al-Awar, O., Rosenblatt, J., Wong, M. L., Alberts, B., and Mitchison, T. J. (1996). A purified *Drosophila* septin complex forms filaments and exhibits GTPase activity. J Cell Biol 133, 605-616.

Gladfelter, A. S., Bose, I., Zyla, T. R., Bardes, E. S., and Lew, D. J. (2002). Septin ring assembly involves cycles of GTP loading and hydrolysis by Cdc42p. J Cell Biol 156, 315-326.

Hall, P. A., Jung, K., Hillan, K. J., and Russell, S. H. (2005). Expression profiling the human septin gene family. J Pathol 206, 269-278.

Hall, P. A., and Russell, S. E. (2004). The pathobiology of the septin gene family. J Pathol 204, 489-505.

Hewitson, K. S., McNeill, L. A., Riordan, M. V., Tian, Y. M., Bullock, A. N., Welford, R. W., Elkins, J. M., Oldham, N. J., Bhattacharya, S., Gleadle, J. M., et al. (2002). Hypoxia-inducible factor (HIF) asparagine hydroxylase is identical to factor inhibiting HIF (FIH) and is related to the cupin structural family. J Biol Chem 277, 26351-26355.

Hirota, K., and Semenza, G. L. (2001). Rac1 activity is required for the activation of hypoxia-inducible factor 1. J Biol Chem 276, 21166-21172.

Hopfl, G., Ogunshola, O., and Gassmann, M. (2004). HIFs and tumors—causes and consequences. Am J Physiol Regul Integr Comp Physiol 286, R608-623.

Ivan, M., Kondo, K., Yang, H., Kim, W., Valiando, J., Ohh, M., Salic, A., Asara, J. M., Lane, W. S., and Kaelin, W. G., Jr. (2001). HIFalpha targeted for VHL-mediated destruction by proline hydroxylation: implications for O2 sensing. Science 292, 464-468.

Jeong, J. W., Bae, M. K., Ahn, M. Y., Kim, S. H., Sohn, T. K., Bae, M. H., Yoo, M. A., Song, E. J., Lee, K. J., and Kim, K.

W. (2002). Regulation and destabilization of HIF-1alpha by ARD1-mediated acetylation. Cell 111, 709-720.

Kartmann, B., and Roth, D. (2001). Novel roles for mammalian septins: from vesicle trafficking to oncogenesis. J Cell Sci 114, 839-844.

Kim, W., and Kaelin, W. G., Jr. (2003). The von Hippel-Lindau tumor suppressor protein: new insights into oxygen sensing and cancer. Curr Opin Genet Dev 13, 55-60.

Lando, D., Peet, D. J., Gorman, J. J., Whelan, D. A., Whitelaw, M. L., and Bruick, R. K. (2002). FIH-1 is an asparaginyl hydroxylase enzyme that regulates the transcriptional activity of hypoxia-inducible factor. Genes Dev 16, 1466-1471.

Mabjeesh, N. J., Post, D. E., Willard, M. T., Kaur, B., Van Meir, E. G., Simons, J. W., and Zhong, H. (2002). Geldanamycin induces degradation of hypoxia-inducible factor 1 alpha protein via the proteosome pathway in prostate cancer cells. Cancer Res 62, 2478-2482.

Macara, I. G., Baldarelli, R., Field, C. M., Glotzer, M., Hayashi, Y., Hsu, S. C., Kennedy, M. B., Kinoshita, M., Longtine, M., Low, C., et al. (2002). Mammalian septins nomenclature. Mol Biol Cell 13, 4111-4113.

Mahon, P. C., Hirota, K., and Semenza, G. L. (2001). FIH-1: a novel protein that interacts with HIF-1alpha and VHL to mediate repression of HIF-1 transcriptional activity. Genes Dev 15, 2675-2686.

Maxwell, P. H., Dachs, G. U., Gleadle, J. M., Nicholls, L. G., Harris, A. L., Stratford, I. J., Hankinson, O., Pugh, C. W., and Ratcliffe, P. J. (1997). Hypoxia-inducible factor-1 modulates gene expression in solid tumors and influences both angiogenesis and tumor growth. Proc Natl Acad Sci USA 94, 8104-8109.

Maxwell, P. H., and Ratcliffe, P. J. (2002). Oxygen sensors and angiogenesis. Semin Cell Dev Biol 13, 29-37.

Melillo, G. (2004). HIF-1: a target for cancer, ischemia and inflammation—too good to be true? Cell Cycle 3, 154-155.

Mendoza, M., Hyman, A. A., and Glotzer, M. (2002). GTP binding induces filament assembly of a recombinant septin. Curr Biol 12, 1858-1863.

Metzen, E., Berchner-Pfannschmidt, U., Stengel, P., Marxsen, J. H., Stolze, I., Klinger, M., Huang, W. Q., Wotzlaw, C., Hellwig-Burgel, T., Jelkmann, W., et al. (2003). Intracellular localisation of human HIF-1 alpha hydroxylases: implications for oxygen sensing. J Cell Sci 116, 1319-1326.

Montagna, C., Lyu, M. S., Hunter, K., Lukes, L., Lowther, W., Reppert, T., Hissong, B., Weaver, Z., and Ried, T. (2003). The Septin 9 (MSF) gene is amplified and overexpressed in mouse mammary gland adenocarcinomas and human breast cancer cell lines. Cancer Res 63, 2179-2187.

Nagata, K., and Inagaki, M. (2005). Cytoskeletal modification of Rho guanine nucleotide exchange factor activity: identification of a Rho guanine nucleotide exchange factor as a binding partner for Sept9b, a mammalian septin. Oncogene 24, 65-76.

Osaka, M., Rowley, J. D., and Zeleznik-Le, N.J. (1999). MSF (MLL septin-like fusion), a fusion partner gene of MLL, in a therapy-related acute myeloid leukemia with a t(11; 17) (q23; q25). Proc Natl Acad Sci USA 96, 6428-6433.

Post, D. E., and Van Meir, E. G. (2001). Generation of bidirectional hypoxia/HIF-responsive expression vectors to target gene expression to hypoxic cells. Gene Ther 8, 1801-1807.

Quintero, M., Mackenzie, N., and Brennan, P. A. (2004). Hypoxia-inducible factor 1 (HIF-1) in cancer. Eur J Surg Oncol 30, 465-468.

Robertson, C., Church, S. W., Nagar, H. A., Price, J., Hall, P. A., and Russell, S. E. (2004). Properties of SEPT9 isoforms and the requirement for GTP binding. J Pathol 203, 519-527.

Ryan, H. E., Lo, J., and Johnson, R. S. (1998). HIF-1 alpha is required for solid tumor formation and embryonic vascularization. Embo J 17, 3005-3015.

Ryan, H. E., Poloni, M., McNulty, W., Elson, D., Gassmann, M., Arbeit, J. M., and Johnson, R. S. (2000). Hypoxia-inducible factor-1alpha is a positive factor in solid tumor growth. Cancer Res 60, 4010-4015.

Scott, M., Hyland, P. L., McGregor, G., Hillan, K. J., Russell, S. E., and Hall, P. A. (2005). Multimodality expression profiling shows SEPT9 to be overexpressed in a wide range of human tumours. Oncogene.

Semenza, G. L. (2003). Targeting HIF-1 for cancer therapy. Nat Rev Cancer 3, 721-732.

Semenza, G. L. (2004). Hydroxylation of HIF-1: oxygen sensing at the molecular level. Physiology (Bethesda) 19, 176-182.

Taki, T., Ohnishi, H., Shinohara, K., Sako, M., Bessho, F., Yanagisawa, M., and Hayashi, Y. (1999). AF17q25, a putative septin family gene, fuses the MLL gene in acute myeloid leukemia with t(11; 17)(q23; q25). Cancer Res 59, 4261-4265.

Vaupel, P. (2004). The role of hypoxia-induced factors in tumor progression. Oncologist 9 Suppl 5, 10-17.

Versele, M., and Thomer, J. (2004). Septin collar formation in budding yeast requires GTP binding and direct phosphorylation by the PAK, Cla4. J Cell Biol 164, 701-715.

Welsh, S. J., and Powis, G. (2003). Hypoxia inducible factor as a cancer drug target. Curr Cancer Drug Targets 3, 391-405.

Wenger, R. H. (2002). Cellular adaptation to hypoxia: $O_2$-sensing protein hydroxylases, hypoxia-inducible transcription factors, and $O_2$-regulated gene expression. Faseb J 16, 1151-1162.

Zhong, H., Agani, F., Baccala, A. A., Laughner, E., Rioseco-Camacho, N., Isaacs, W. B., Simons, J. W., and Semenza, G. L. (1998). Increased expression of hypoxia inducible factor-1alpha in rat and human prostate cancer. Cancer Res 58, 5280-5284.

Zhong, H., De Marzo, A. M., Laughner, E., Lim, M., Hilton, D. A., Zagzag, D., Buechler, P., Isaacs, W. B., Semenza, G. L., and Simons, J. W. (1999). Overexpression of hypoxia-inducible factor 1alpha in common human cancers and their metastases. Cancer Res 59, 5830-5835.

CD-ROM CONTENT

The following lists the file content of the CD-ROM which is enclosed herewith and filed with the application. File information is provided as: File name/byte size/date of creation/operating system/machine format.

CD-ROM1

1. 33027 Sequence Listing.txt/892,928 bytes/Jan. 9, 2007/ PC/Microsoft Windows XP Professional/. The text file named 33027 Sequence Listing.txt includes SEQ ID NOs:1-4216.

SEQUENCE LISTING (4216 sequences)

SEQ ID NO: 1 - DNA, 3813 bp, Homo sapiens
gccttcctactaccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccagagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggttggagggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccaaaaaaaaaaaaaaaaaaa

SEQ ID NO: 2 - DNA, 3958 bp, Homo sapiens
gtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggaaaaaaaaaaaaaaaaaaa

SEQ ID NO: 3 - protein, 586 aa, Homo sapiens [sequence omitted]

SEQ ID NO: 4 - DNA, 43 bp, Artificial sequence
  Single strand DNA oligonucleotide
gactaagcttatgaagaagtcttactcaggaggcacgcggacc

SEQ ID NO: 5 - DNA, 47 bp, Artificial sequence
  Single strand DNA oligonucleotide
acgttctagattactacatctctggggcttctggctccttctcctcc

SEQ ID NO: 6 - DNA, 33 bp, Artificial sequence
  Single strand DNA oligonucleotide
gacaagcttgccttgaaaagatcttttgaggtc

SEQ ID NO: 7 - DNA, 1685 bp, Homo sapiens
gccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccagagatgta

SEQ ID NO: 8 - DNA, 38 bp, Artificial sequence
  Single strand DNA oligonucleotide
acgtgcggccgcgatggagggcgccggcggcgcgaacg

SEQ ID NO: 9 - DNA, 40 bp, Artificial sequence
  Single strand DNA oligonucleotide
cagttctagattatcagttaacttgatccaaagctctgag

SEQ ID NO: 10 - protein, 561 aa, Homo sapiens
ALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 11 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 12 - protein, 5 aa, Artificial sequence
  Synthetic peptide
MEGAG

SEQ ID NO: 13 - protein, 5 aa, Artificial sequence
  Synthetic peptide
EGAGG

SEQ ID NO: 14 - protein, 5 aa, Artificial sequence
  Synthetic peptide
GAGGA

SEQ ID NO: 15 - protein, 5 aa, Artificial sequence
  Synthetic peptide
AGGAN

SEQ ID NO: 16 - protein, 5 aa, Artificial sequence
  Synthetic peptide
GGAND

SEQ ID NO: 17 - protein, 5 aa, Artificial sequence
  Synthetic peptide
GANDK

SEQ ID NO: 18 - protein, 5 aa, Artificial sequence
  Synthetic peptide
ANDKK

SEQ ID NO: 19 - protein, 5 aa, Artificial sequence
  Synthetic peptide
NDKKK

SEQ ID NO: 20 - protein, 5 aa, Artificial sequence
  Synthetic peptide
DKKKI

SEQ ID NO: 21 - protein, 5 aa, Artificial sequence
  Synthetic peptide
KKKIS

SEQ ID NO: 22 - protein, 5 aa, Artificial sequence
  Synthetic peptide
KKISS

SEQ ID NO: 23 - protein, 5 aa, Artificial sequence
  Synthetic peptide
KISSE

SEQ ID NO: 24 - protein, 5 aa, Artificial sequence
  Synthetic peptide
ISSER

SEQ ID NO: 25 - protein, 5 aa, Artificial sequence
  Synthetic peptide
SSERR

SEQ ID NO: 26 - protein, 5 aa, Artificial sequence
  Synthetic peptide
SERRK

SEQ ID NO: 27 - protein, 5 aa, Artificial sequence
  Synthetic peptide
ERRKE

SEQ ID NO: 28 - protein, 5 aa, Artificial sequence
  Synthetic peptide
RRKEK

SEQ ID NO: 29 - protein, 5 aa, Artificial sequence
  Synthetic peptide
RKEKS

SEQ ID NO: 30 - protein, 5 aa, Artificial sequence
  Synthetic peptide
KEKSR

SEQ ID NO: 31 - protein, 5 aa, Artificial sequence
  Synthetic peptide
EKSRD

SEQ ID NO: 32 - protein, 5 aa, Artificial sequence
  Synthetic peptide
KSRDA

SEQ ID NO: 33 - protein, 5 aa, Artificial sequence
  Synthetic peptide
SRDAA

SEQ ID NO: 34 - protein, 5 aa, Artificial sequence
  Synthetic peptide
RDAAR

SEQ ID NO: 35 - protein, 5 aa, Artificial sequence
  Synthetic peptide
DAARS

SEQ ID NO: 36 - protein, 5 aa, Artificial sequence
  Synthetic peptide
AARSR

SEQ ID NO: 37 - protein, 5 aa, Artificial sequence
  Synthetic peptide
ARSRR

SEQ ID NO: 38 - protein, 5 aa, Artificial sequence
  Synthetic peptide
RSRRS

SEQ ID NO: 39 - protein, 5 aa, Artificial sequence
  Synthetic peptide
SRRSK

SEQ ID NO: 40 - protein, 5 aa, Artificial sequence
  Synthetic peptide
RRSKE

SEQ ID NO: 41 - protein, 5 aa, Artificial sequence
  Synthetic peptide
RSKES

SEQ ID NO: 42 - protein, 5 aa, Artificial sequence
  Synthetic peptide
SKESE

SEQ ID NO: 43 - protein, 5 aa, Artificial sequence
  Synthetic peptide
KESEV

SEQ ID NO: 44 - protein, 5 aa, Artificial sequence
  Synthetic peptide
ESEVF

SEQ ID NO: 45 - protein, 5 aa, Artificial sequence
  Synthetic peptide
SEVFY

SEQ ID NO: 46 - protein, 5 aa, Artificial sequence
  Synthetic peptide
EVFYE

SEQ ID NO: 47 - protein, 5 aa, Artificial sequence
  Synthetic peptide
VFYEL

SEQ ID NO: 48 - protein, 5 aa, Artificial sequence
  Synthetic peptide
FYELA

SEQ ID NO: 49 - protein, 5 aa, Artificial sequence
  Synthetic peptide
YELAH

SEQ ID NO: 50 - protein, 5 aa, Artificial sequence
  Synthetic peptide
ELAHQ

SEQ ID NO: 51 - protein, 5 aa, Artificial sequence
  Synthetic peptide
LAHQL

SEQ ID NO: 52 - protein, 5 aa, Artificial sequence
  Synthetic peptide
AHQLP

SEQ ID NO: 53 - protein, 5 aa, Artificial sequence
  Synthetic peptide
HQLPL

SEQ ID NO: 54 - protein, 5 aa, Artificial sequence
  Synthetic peptide
QLPLP

SEQ ID NO: 55 - protein, 5 aa, Artificial sequence
  Synthetic peptide
LPLPH

SEQ ID NO: 56 - protein, 5 aa, Artificial sequence
  Synthetic peptide
PLPHN

SEQ ID NO: 57 - protein, 5 aa, Artificial sequence
  Synthetic peptide
LPHNV

SEQ ID NO: 58 - protein, 5 aa, Artificial sequence
  Synthetic peptide
PHNVS

SEQ ID NO: 59 - protein, 5 aa, Artificial sequence
  Synthetic peptide
HNVSS

SEQ ID NO: 60 - protein, 5 aa, Artificial sequence
  Synthetic peptide
NVSSH

SEQ ID NO: 61 - protein, 5 aa, Artificial sequence
  Synthetic peptide
VSSHL

SEQ ID NO: 62 - protein, 5 aa, Artificial sequence
  Synthetic peptide
SSHLD

SEQ ID NO: 63 - protein, 5 aa, Artificial sequence
  Synthetic peptide
SHLDK

SEQ ID NO: 64 - protein, 5 aa, Artificial sequence
  Synthetic peptide
HLDKA

SEQ ID NO: 65 - protein, 5 aa, Artificial sequence
  Synthetic peptide
LDKAS

SEQ ID NO: 66 - protein, 5 aa, Artificial sequence
  Synthetic peptide
DKASV

SEQ ID NO: 67 - protein, 5 aa, Artificial sequence
  Synthetic peptide
KASVM

SEQ ID NO: 68 - protein, 5 aa, Artificial sequence
  Synthetic peptide
ASVMR

SEQ ID NO: 69 - protein, 5 aa, Artificial sequence
  Synthetic peptide
SVMRL

SEQ ID NO: 70 - protein, 5 aa, Artificial sequence
  Synthetic peptide
VMRLT

SEQ ID NO: 71 - protein, 5 aa, Artificial sequence
  Synthetic peptide
MRLTI

SEQ ID NO: 72 - protein, 5 aa, Artificial sequence
  Synthetic peptide
RLTIS

SEQ ID NO: 73 - protein, 5 aa, Artificial sequence
  Synthetic peptide
LTISY

SEQ ID NO: 74 - protein, 5 aa, Artificial sequence
  Synthetic peptide
TISYL

SEQ ID NO: 75 - protein, 5 aa, Artificial sequence
  Synthetic peptide
ISYLR

SEQ ID NO: 76 - protein, 5 aa, Artificial sequence
  Synthetic peptide
SYLRV

SEQ ID NO: 77 - protein, 5 aa, Artificial sequence
  Synthetic peptide
YLRVR

SEQ ID NO: 78 - protein, 5 aa, Artificial sequence
  Synthetic peptide
LRVRK

SEQ ID NO: 79 - protein, 5 aa, Artificial sequence
  Synthetic peptide
RVRKL

SEQ ID NO: 80 - protein, 5 aa, Artificial sequence
  Synthetic peptide
VRKLL

SEQ ID NO: 81 - protein, 5 aa, Artificial sequence
  Synthetic peptide
RKLLD

SEQ ID NO: 82 - protein, 5 aa, Artificial sequence
  Synthetic peptide
KLLDA

SEQ ID NO: 83 - protein, 5 aa, Artificial sequence
  Synthetic peptide
LLDAG

SEQ ID NO: 84 - protein, 5 aa, Artificial sequence
  Synthetic peptide
LDAGD

SEQ ID NO: 85 - protein, 5 aa, Artificial sequence
  Synthetic peptide
DAGDL

SEQ ID NO: 86 - protein, 5 aa, Artificial sequence
  Synthetic peptide
AGDLD

SEQ ID NO: 87 - protein, 5 aa, Artificial sequence
  Synthetic peptide
GDLDI

SEQ ID NO: 88 - protein, 5 aa, Artificial sequence
  Synthetic peptide
DLDIE

SEQ ID NO: 89 - protein, 5 aa, Artificial sequence
  Synthetic peptide
LDIED

SEQ ID NO: 90 - protein, 5 aa, Artificial sequence
  Synthetic peptide
DIEDD

SEQ ID NO: 91 - protein, 5 aa, Artificial sequence
  Synthetic peptide
IEDDM

SEQ ID NO: 92 - protein, 5 aa, Artificial sequence
  Synthetic peptide
EDDMK

SEQ ID NO: 93 - protein, 5 aa, Artificial sequence
  Synthetic peptide
DDMKA

SEQ ID NO: 94 - protein, 5 aa, Artificial sequence
  Synthetic peptide
DMKAQ

SEQ ID NO: 95 - protein, 5 aa, Artificial sequence
  Synthetic peptide
MKAQM

SEQ ID NO: 96 - protein, 5 aa, Artificial sequence
  Synthetic peptide
KAQMN

SEQ ID NO: 97 - protein, 5 aa, Artificial sequence
  Synthetic peptide
AQMNC

SEQ ID NO: 98 - protein, 5 aa, Artificial sequence
  Synthetic peptide
QMNCF

SEQ ID NO: 99 - protein, 5 aa, Artificial sequence
  Synthetic peptide
MNCFY

SEQ ID NO: 100 - protein, 5 aa, Artificial sequence
  Synthetic peptide
NCFYL

SEQ ID NO: 101 - protein, 5 aa, Artificial sequence
  Synthetic peptide
CFYLK

SEQ ID NO: 102 - protein, 5 aa, Artificial sequence
  Synthetic peptide
FYLKA

SEQ ID NO: 103 - protein, 5 aa, Artificial sequence
  Synthetic peptide
YLKAL

SEQ ID NO: 104 - protein, 5 aa, Artificial sequence
  Synthetic peptide
LKALD

SEQ ID NO: 105 - protein, 5 aa, Artificial sequence
  Synthetic peptide
KALDG

SEQ ID NO: 106 - protein, 5 aa, Artificial sequence
  Synthetic peptide
ALDGF

SEQ ID NO: 107 - protein, 5 aa, Artificial sequence
  Synthetic peptide
LDGFV

SEQ ID NO: 108 - protein, 5 aa, Artificial sequence
  Synthetic peptide
DGFVM

SEQ ID NO: 109 - protein, 5 aa, Artificial sequence
  Synthetic peptide
GFVMV

SEQ ID NO: 110 - protein, 5 aa, Artificial sequence
  Synthetic peptide
FVMVL

SEQ ID NO: 111 - protein, 5 aa, Artificial sequence
  Synthetic peptide
VMVLT

SEQ ID NO: 112 - protein, 5 aa, Artificial sequence
  Synthetic peptide
MVLTD

SEQ ID NO: 113 - protein, 5 aa, Artificial sequence
  Synthetic peptide
VLTDD

SEQ ID NO: 114 - protein, 5 aa, Artificial sequence
  Synthetic peptide
LTDDG

SEQ ID NO: 115 - protein, 5 aa, Artificial sequence
  Synthetic peptide
TDDGD

SEQ ID NO: 116 - protein, 5 aa, Artificial sequence
  Synthetic peptide
DDGDM

SEQ ID NO: 117 - protein, 5 aa, Artificial sequence
  Synthetic peptide
DGDMI

SEQ ID NO: 118 - protein, 5 aa, Artificial sequence
  Synthetic peptide
GDMIY

SEQ ID NO: 119 - protein, 5 aa, Artificial sequence
  Synthetic peptide
DMIYI

SEQ ID NO: 120 - protein, 5 aa, Artificial sequence
  Synthetic peptide
MIYIS

SEQ ID NO: 121 - protein, 5 aa, Artificial sequence
  Synthetic peptide
IYISD

SEQ ID NO: 122 - protein, 5 aa, Artificial sequence
  Synthetic peptide
YISDN

SEQ ID NO: 123 - protein, 5 aa, Artificial sequence
  Synthetic peptide
ISDNV

SEQ ID NO: 124 - protein, 5 aa, Artificial sequence
  Synthetic peptide
SDNVN

SEQ ID NO: 125 - protein, 5 aa, Artificial sequence
  Synthetic peptide
DNVNK

SEQ ID NO: 126 - protein, 5 aa, Artificial sequence
  Synthetic peptide
NVNKY

SEQ ID NO: 127 - protein, 5 aa, Artificial sequence
  Synthetic peptide
VNKYM

SEQ ID NO: 128 - protein, 5 aa, Artificial sequence
  Synthetic peptide
NKYMG

SEQ ID NO: 129 - protein, 5 aa, Artificial sequence
  Synthetic peptide
KYMGL

SEQ ID NO: 130 - protein, 5 aa, Artificial sequence
  Synthetic peptide
YMGLT

SEQ ID NO: 131 - protein, 5 aa, Artificial sequence
  Synthetic peptide
MGLTQ

SEQ ID NO: 132 - protein, 5 aa, Artificial sequence
  Synthetic peptide
GLTQF

SEQ ID NO: 133 - protein, 5 aa, Artificial sequence
  Synthetic peptide
LTQFE

SEQ ID NO: 134 - protein, 5 aa, Artificial sequence
  Synthetic peptide
TQFEL

SEQ ID NO: 135 - protein, 5 aa, Artificial sequence
  Synthetic peptide
QFELT

SEQ ID NO: 136 - protein, 5 aa, Artificial sequence
  Synthetic peptide
FELTG

SEQ ID NO: 137 - protein, 5 aa, Artificial sequence
  Synthetic peptide
ELTGH

SEQ ID NO: 138 - protein, 5 aa, Artificial sequence
  Synthetic peptide
LTGHS

SEQ ID NO: 139 - protein, 5 aa, Artificial sequence
  Synthetic peptide
TGHSV

SEQ ID NO: 140 - protein, 5 aa, Artificial sequence
  Synthetic peptide
GHSVF

SEQ ID NO: 141 - protein, 5 aa, Artificial sequence
  Synthetic peptide
HSVFD

SEQ ID NO: 142 - protein, 5 aa, Artificial sequence
  Synthetic peptide
SVFDF

SEQ ID NO: 143 - protein, 5 aa, Artificial sequence
  Synthetic peptide
VFDFT

SEQ ID NO: 144 - protein, 5 aa, Artificial sequence
  Synthetic peptide
FDFTH

SEQ ID NO: 145 - protein, 5 aa, Artificial sequence
  Synthetic peptide
DFTHP

SEQ ID NO: 146 - protein, 5 aa, Artificial sequence
  Synthetic peptide
FTHPC

SEQ ID NO: 147 - protein, 5 aa, Artificial sequence
  Synthetic peptide
THPCD

SEQ ID NO: 148 - protein, 5 aa, Artificial sequence
  Synthetic peptide
HPCDH

SEQ ID NO: 149 - protein, 5 aa, Artificial sequence
  Synthetic peptide
PCDHE

SEQ ID NO: 150 - protein, 5 aa, Artificial sequence
  Synthetic peptide
CDHEE

SEQ ID NO: 151 - protein, 5 aa, Artificial sequence
  Synthetic peptide
DHEEM

SEQ ID NO: 152 - protein, 5 aa, Artificial sequence
  Synthetic peptide
HEEMR

SEQ ID NO: 153 - protein, 5 aa, Artificial sequence
  Synthetic peptide
EEMRE

SEQ ID NO: 154 - protein, 5 aa, Artificial sequence
  Synthetic peptide
EMREM

SEQ ID NO: 155 - protein, 5 aa, Artificial sequence
  Synthetic peptide
MREML

SEQ ID NO: 156 - protein, 5 aa, Artificial sequence
  Synthetic peptide
REMLT

SEQ ID NO: 157 - protein, 5 aa, Artificial sequence
  Synthetic peptide
EMLTH

SEQ ID NO: 158 - protein, 5 aa, Artificial sequence
  Synthetic peptide
MLTHR

SEQ ID NO: 159 - protein, 5 aa, Artificial sequence
  Synthetic peptide
LTHRN

SEQ ID NO: 160 - protein, 5 aa, Artificial sequence
  Synthetic peptide
THRNG

SEQ ID NO: 161 - protein, 5 aa, Artificial sequence
  Synthetic peptide
HRNGL

SEQ ID NO: 162 - protein, 5 aa, Artificial sequence
  Synthetic peptide
RNGLV

SEQ ID NO: 163 - protein, 5 aa, Artificial sequence
  Synthetic peptide
NGLVK

SEQ ID NO: 164 - protein, 5 aa, Artificial sequence
  Synthetic peptide
GLVKK

SEQ ID NO: 165 - protein, 5 aa, Artificial sequence
  Synthetic peptide
LVKKG

SEQ ID NO: 166 - protein, 5 aa, Artificial sequence
  Synthetic peptide
VKKGK

SEQ ID NO: 167 - protein, 5 aa, Artificial sequence
  Synthetic peptide
KKGKE

SEQ ID NO: 168 - protein, 5 aa, Artificial sequence
  Synthetic peptide
KGKEQ

SEQ ID NO: 169 - protein, 5 aa, Artificial sequence
  Synthetic peptide
GKEQN

SEQ ID NO: 170 - protein, 5 aa, Artificial sequence
  Synthetic peptide
KEQNT

SEQ ID NO: 171 - protein, 5 aa, Artificial sequence
  Synthetic peptide
EQNTQ

SEQ ID NO: 172 - protein, 5 aa, Artificial sequence
  Synthetic peptide
QNTQR

SEQ ID NO: 173 - protein, 5 aa, Artificial sequence
  Synthetic peptide
NTQRS

SEQ ID NO: 174 - protein, 5 aa, Artificial sequence
  Synthetic peptide
TQRSF

SEQ ID NO: 175 - protein, 5 aa, Artificial sequence
  Synthetic peptide
QRSFF

SEQ ID NO: 176 - protein, 5 aa, Artificial sequence
  Synthetic peptide
RSFFL

SEQ ID NO: 177 - protein, 5 aa, Artificial sequence
  Synthetic peptide
SFFLR

SEQ ID NO: 178 - protein, 5 aa, Artificial sequence
  Synthetic peptide
FFLRM

SEQ ID NO: 179 - protein, 5 aa, Artificial sequence
  Synthetic peptide
FLRMK

SEQ ID NO: 180 - protein, 5 aa, Artificial sequence
  Synthetic peptide
LRMKC

SEQ ID NO: 181 - protein, 5 aa, Artificial sequence
  Synthetic peptide
RMKCT

SEQ ID NO: 182 - protein, 5 aa, Artificial sequence
  Synthetic peptide
MKCTL

SEQ ID NO: 183 - protein, 5 aa, Artificial sequence
  Synthetic peptide
KCTLT

SEQ ID NO: 184 - protein, 5 aa, Artificial sequence
  Synthetic peptide
CTLTS

SEQ ID NO: 185 - protein, 5 aa, Artificial sequence
  Synthetic peptide
TLTSR

SEQ ID NO: 186 - protein, 5 aa, Artificial sequence
  Synthetic peptide
LTSRG

SEQ ID NO: 187 - protein, 5 aa, Artificial sequence
  Synthetic peptide
TSRGR

SEQ ID NO: 188 - protein, 5 aa, Artificial sequence
  Synthetic peptide
SRGRT

SEQ ID NO: 189 - protein, 5 aa, Artificial sequence
  Synthetic peptide
RGRTM

SEQ ID NO: 190 - protein, 5 aa, Artificial sequence
  Synthetic peptide
GRTMN

SEQ ID NO: 191 - protein, 5 aa, Artificial sequence
  Synthetic peptide
RTMNI

SEQ ID NO: 192 - protein, 5 aa, Artificial sequence
  Synthetic peptide
TMNIK

SEQ ID NO: 193 - protein, 5 aa, Artificial sequence
  Synthetic peptide
MNIKS

SEQ ID NO: 194 - protein, 5 aa, Artificial sequence
  Synthetic peptide
NIKSA

SEQ ID NO: 195 - protein, 5 aa, Artificial sequence
  Synthetic peptide
IKSAT

SEQ ID NO: 196 - protein, 5 aa, Artificial sequence
  Synthetic peptide
KSATW

SEQ ID NO: 197 - protein, 5 aa, Artificial sequence
  Synthetic peptide
SATWK

SEQ ID NO: 198 - protein, 5 aa, Artificial sequence
  Synthetic peptide
ATWKV

SEQ ID NO: 199 - protein, 5 aa, Artificial sequence
  Synthetic peptide
TWKVL

SEQ ID NO: 200 - protein, 5 aa, Artificial sequence
  Synthetic peptide
WKVLH

SEQ ID NO: 201 - protein, 5 aa, Artificial sequence
  Synthetic peptide
KVLHC

SEQ ID NO: 202 - protein, 5 aa, Artificial sequence
  Synthetic peptide
VLHCT

SEQ ID NO: 203 - protein, 5 aa, Artificial sequence
  Synthetic peptide
LHCTG

SEQ ID NO: 204 - protein, 5 aa, Artificial sequence
  Synthetic peptide
HCTGH

SEQ ID NO: 205 - protein, 5 aa, Artificial sequence
  Synthetic peptide
CTGHI

SEQ ID NO: 206 - protein, 5 aa, Artificial sequence
  Synthetic peptide
TGHIH

SEQ ID NO: 207 - protein, 5 aa, Artificial sequence
  Synthetic peptide
GHIHV

SEQ ID NO: 208 - protein, 5 aa, Artificial sequence
  Synthetic peptide
HIHVY

SEQ ID NO: 209 - protein, 5 aa, Artificial sequence
  Synthetic peptide
IHVYD

SEQ ID NO: 210 - protein, 5 aa, Artificial sequence
  Synthetic peptide
HVYDT

SEQ ID NO: 211 - protein, 5 aa, Artificial sequence
  Synthetic peptide
VYDTN

SEQ ID NO: 212 - protein, 5 aa, Artificial sequence
  Synthetic peptide
YDTNS

SEQ ID NO: 213 - protein, 5 aa, Artificial sequence
  Synthetic peptide
DTNSN

SEQ ID NO: 214 - protein, 5 aa, Artificial sequence
  Synthetic peptide
TNSNQ

SEQ ID NO: 215 - protein, 5 aa, Artificial sequence
  Synthetic peptide
NSNQP

SEQ ID NO: 216 - protein, 5 aa, Artificial sequence
  Synthetic peptide
SNQPQ

SEQ ID NO: 217 - protein, 5 aa, Artificial sequence
  Synthetic peptide
NQPQC

SEQ ID NO: 218 - protein, 5 aa, Artificial sequence
  Synthetic peptide
QPQCG

SEQ ID NO: 219 - protein, 5 aa, Artificial sequence
  Synthetic peptide
PQCGY

SEQ ID NO: 220 - protein, 5 aa, Artificial sequence
  Synthetic peptide
QCGYK

SEQ ID NO: 221 - protein, 5 aa, Artificial sequence
  Synthetic peptide
CGYKK

SEQ ID NO: 222 - protein, 5 aa, Artificial sequence
  Synthetic peptide
GYKKP

SEQ ID NO: 223 - protein, 5 aa, Artificial sequence
  Synthetic peptide
YKKPP

SEQ ID NO: 224 - protein, 5 aa, Artificial sequence
  Synthetic peptide
KKPPM

SEQ ID NO: 225 - protein, 5 aa, Artificial sequence
  Synthetic peptide
KPPMT

SEQ ID NO: 226 - protein, 5 aa, Artificial sequence
  Synthetic peptide
PPMTC

SEQ ID NO: 227 - protein, 5 aa, Artificial sequence
  Synthetic peptide
PMTCL

SEQ ID NO: 228 - protein, 5 aa, Artificial sequence
  Synthetic peptide
MTCLV

SEQ ID NO: 229 - protein, 5 aa, Artificial sequence
  Synthetic peptide
TCLVL

SEQ ID NO: 230 - protein, 5 aa, Artificial sequence
  Synthetic peptide
CLVLI

SEQ ID NO: 231 - protein, 5 aa, Artificial sequence
  Synthetic peptide
LVLIC

SEQ ID NO: 232 - protein, 5 aa, Artificial sequence
  Synthetic peptide
VLICE

SEQ ID NO: 233 - protein, 5 aa, Artificial sequence
  Synthetic peptide
LICEP

SEQ ID NO: 234 - protein, 5 aa, Artificial sequence
  Synthetic peptide
ICEPI

SEQ ID NO: 235 - protein, 5 aa, Artificial sequence
  Synthetic peptide
CEPIP

SEQ ID NO: 236 - protein, 5 aa, Artificial sequence
  Synthetic peptide
EPIPH

SEQ ID NO: 237 - protein, 5 aa, Artificial sequence
  Synthetic peptide
PIPHP

SEQ ID NO: 238 - protein, 5 aa, Artificial sequence
  Synthetic peptide
IPHPS

SEQ ID NO: 239 - protein, 5 aa, Artificial sequence
  Synthetic peptide
PHPSN

SEQ ID NO: 240 - protein, 5 aa, Artificial sequence
  Synthetic peptide
HPSNI

SEQ ID NO: 241 - protein, 5 aa, Artificial sequence
  Synthetic peptide
PSNIE

SEQ ID NO: 242 - protein, 5 aa, Artificial sequence
  Synthetic peptide
SNIEI

SEQ ID NO: 243 - protein, 5 aa, Artificial sequence
  Synthetic peptide
NIEIP

SEQ ID NO: 244 - protein, 5 aa, Artificial sequence
  Synthetic peptide
IEIPL

SEQ ID NO: 245 - protein, 5 aa, Artificial sequence
  Synthetic peptide
EIPLD

SEQ ID NO: 246 - protein, 5 aa, Artificial sequence
  Synthetic peptide
IPLDS

SEQ ID NO: 247 - protein, 5 aa, Artificial sequence
  Synthetic peptide
PLDSK

SEQ ID NO: 248 - protein, 5 aa, Artificial sequence
  Synthetic peptide
LDSKT

SEQ ID NO: 249 - protein, 5 aa, Artificial sequence
  Synthetic peptide
DSKTF

SEQ ID NO: 250 - protein, 5 aa, Artificial sequence
  Synthetic peptide
SKTFL

SEQ ID NO: 251 - protein, 5 aa, Artificial sequence
  Synthetic peptide
KTFLS

SEQ ID NO: 252 - protein, 5 aa, Artificial sequence
  Synthetic peptide
TFLSR

SEQ ID NO: 253 - protein, 5 aa, Artificial sequence
  Synthetic peptide
FLSRH

SEQ ID NO: 254 - protein, 5 aa, Artificial sequence
  Synthetic peptide
LSRHS

SEQ ID NO: 255 - protein, 5 aa, Artificial sequence
  Synthetic peptide
SRHSL

SEQ ID NO: 256 - protein, 5 aa, Artificial sequence
  Synthetic peptide
RHSLD

SEQ ID NO: 257 - protein, 5 aa, Artificial sequence
  Synthetic peptide
HSLDM

SEQ ID NO: 258 - protein, 5 aa, Artificial sequence
  Synthetic peptide
SLDMK

SEQ ID NO: 259 - protein, 5 aa, Artificial sequence
  Synthetic peptide
LDMKF

SEQ ID NO: 260 - protein, 5 aa, Artificial sequence
  Synthetic peptide
DMKFS

SEQ ID NO: 261 - protein, 5 aa, Artificial sequence
  Synthetic peptide
MKFSY

SEQ ID NO: 262 - protein, 5 aa, Artificial sequence
  Synthetic peptide
KFSYC

SEQ ID NO: 263 - protein, 5 aa, Artificial sequence
  Synthetic peptide
FSYCD

SEQ ID NO: 264 - protein, 5 aa, Artificial sequence
  Synthetic peptide
SYCDE

SEQ ID NO: 265 - protein, 5 aa, Artificial sequence
  Synthetic peptide
YCDER

SEQ ID NO: 266 - protein, 5 aa, Artificial sequence
  Synthetic peptide
CDERI

SEQ ID NO: 267 - protein, 5 aa, Artificial sequence
  Synthetic peptide
DERIT

SEQ ID NO: 268 - protein, 5 aa, Artificial sequence
  Synthetic peptide
ERITE

SEQ ID NO: 269 - protein, 5 aa, Artificial sequence
  Synthetic peptide
RITEL

SEQ ID NO: 270 - protein, 5 aa, Artificial sequence
  Synthetic peptide
ITELM

SEQ ID NO: 271 - protein, 5 aa, Artificial sequence
  Synthetic peptide
TELMG

SEQ ID NO: 272 - protein, 5 aa, Artificial sequence
  Synthetic peptide
ELMGY

SEQ ID NO: 273 - protein, 5 aa, Artificial sequence
  Synthetic peptide
LMGYE

SEQ ID NO: 274 - protein, 5 aa, Artificial sequence
  Synthetic peptide
MGYEP

SEQ ID NO: 275 - protein, 5 aa, Artificial sequence
  Synthetic peptide
GYEPE

SEQ ID NO: 276 - protein, 5 aa, Artificial sequence
  Synthetic peptide
YEPEE

SEQ ID NO: 277 - protein, 5 aa, Artificial sequence
  Synthetic peptide
EPEEL

SEQ ID NO: 278 - protein, 5 aa, Artificial sequence
  Synthetic peptide
PEELL

SEQ ID NO: 279 - protein, 5 aa, Artificial sequence
  Synthetic peptide
EELLG

SEQ ID NO: 280 - protein, 5 aa, Artificial sequence
  Synthetic peptide
ELLGR

SEQ ID NO: 281 - protein, 5 aa, Artificial sequence
  Synthetic peptide
LLGRS

SEQ ID NO: 282 - protein, 5 aa, Artificial sequence
  Synthetic peptide
LGRSI

SEQ ID NO: 283 - protein, 5 aa, Artificial sequence
  Synthetic peptide
GRSIY

SEQ ID NO: 284 - protein, 5 aa, Artificial sequence
  Synthetic peptide
RSIYE

SEQ ID NO: 285 - protein, 5 aa, Artificial sequence
  Synthetic peptide
SIYEY

SEQ ID NO: 286 - protein, 5 aa, Artificial sequence
  Synthetic peptide
IYEYY

SEQ ID NO: 287 - protein, 5 aa, Artificial sequence
  Synthetic peptide
YEYYH

SEQ ID NO: 288 - protein, 5 aa, Artificial sequence
  Synthetic peptide
EYYHA

SEQ ID NO: 289 - protein, 5 aa, Artificial sequence
  Synthetic peptide
YYHAL

SEQ ID NO: 290 - protein, 5 aa, Artificial sequence
  Synthetic peptide
YHALD

SEQ ID NO: 291 - protein, 5 aa, Artificial sequence
  Synthetic peptide
HALDS

SEQ ID NO: 292 - protein, 5 aa, Artificial sequence
  Synthetic peptide
ALDSD

SEQ ID NO: 293 - protein, 5 aa, Artificial sequence
  Synthetic peptide
LDSDH

SEQ ID NO: 294 - protein, 5 aa, Artificial sequence
  Synthetic peptide
DSDHL

SEQ ID NO: 295 - protein, 5 aa, Artificial sequence
  Synthetic peptide
SDHLT

SEQ ID NO: 296 - protein, 5 aa, Artificial sequence
  Synthetic peptide
DHLTK

SEQ ID NO: 297 - protein, 5 aa, Artificial sequence
  Synthetic peptide
HLTKT

SEQ ID NO: 298 - protein, 5 aa, Artificial sequence
  Synthetic peptide
LTKTH

SEQ ID NO: 299 - protein, 5 aa, Artificial sequence
  Synthetic peptide
TKTHH

SEQ ID NO: 300 - protein, 5 aa, Artificial sequence
  Synthetic peptide
KTHHD

SEQ ID NO: 301 - protein, 5 aa, Artificial sequence
  Synthetic peptide
THHDM

SEQ ID NO: 302 - protein, 5 aa, Artificial sequence
  Synthetic peptide
HHDMF

SEQ ID NO: 303 - protein, 5 aa, Artificial sequence
  Synthetic peptide
HDMFT

SEQ ID NO: 304 - protein, 5 aa, Artificial sequence
  Synthetic peptide
DMFTK

SEQ ID NO: 305 - protein, 5 aa, Artificial sequence
  Synthetic peptide
MFTKG

SEQ ID NO: 306 - protein, 5 aa, Artificial sequence
  Synthetic peptide
FTKGQ

SEQ ID NO: 307 - protein, 5 aa, Artificial sequence
  Synthetic peptide
TKGQV

SEQ ID NO: 308 - protein, 5 aa, Artificial sequence
  Synthetic peptide
KGQVT

SEQ ID NO: 309 - protein, 5 aa, Artificial sequence
  Synthetic peptide
GQVTT

SEQ ID NO: 310 - protein, 5 aa, Artificial sequence
  Synthetic peptide
QVTTG

SEQ ID NO: 311 - protein, 5 aa, Artificial sequence
  Synthetic peptide
VTTGQ

SEQ ID NO: 312 - protein, 5 aa, Artificial sequence
  Synthetic peptide
TTGQY

SEQ ID NO: 313 - protein, 5 aa, Artificial sequence
  Synthetic peptide
TGQYR

SEQ ID NO: 314 - protein, 5 aa, Artificial sequence
  Synthetic peptide
GQYRM

SEQ ID NO: 315 - protein, 5 aa, Artificial sequence
  Synthetic peptide
QYRML

SEQ ID NO: 316 - protein, 5 aa, Artificial sequence
  Synthetic peptide
YRMLA

SEQ ID NO: 317 - protein, 5 aa, Artificial sequence
  Synthetic peptide
RMLAK

SEQ ID NO: 318 - protein, 5 aa, Artificial sequence
  Synthetic peptide
MLAKR

SEQ ID NO: 319 - protein, 5 aa, Artificial sequence
  Synthetic peptide
LAKRG

SEQ ID NO: 320 - protein, 5 aa, Artificial sequence
  Synthetic peptide
AKRGG

SEQ ID NO: 321 - protein, 5 aa, Artificial sequence
  Synthetic peptide
KRGGY

SEQ ID NO: 322 - protein, 5 aa, Artificial sequence
  Synthetic peptide
RGGYV

SEQ ID NO: 323 - protein, 5 aa, Artificial sequence
  Synthetic peptide
GGYVW

SEQ ID NO: 324 - protein, 5 aa, Artificial sequence
  Synthetic peptide
GYVWV

SEQ ID NO: 325 - protein, 5 aa, Artificial sequence
  Synthetic peptide
YVWVE

SEQ ID NO: 326 - protein, 5 aa, Artificial sequence
  Synthetic peptide
VWVET

SEQ ID NO: 327 - protein, 5 aa, Artificial sequence
  Synthetic peptide
WVETQ

SEQ ID NO: 328 - protein, 5 aa, Artificial sequence
  Synthetic peptide
VETQA

SEQ ID NO: 329 - protein, 5 aa, Artificial sequence
  Synthetic peptide
ETQAT

SEQ ID NO: 330 - protein, 5 aa, Artificial sequence
  Synthetic peptide
TQATV

SEQ ID NO: 331 - protein, 5 aa, Artificial sequence
  Synthetic peptide
QATVI

SEQ ID NO: 332 - protein, 5 aa, Artificial sequence
  Synthetic peptide
ATVIY

SEQ ID NO: 333 - protein, 5 aa, Artificial sequence
  Synthetic peptide
TVIYN

SEQ ID NO: 334 - protein, 5 aa, Artificial sequence
  Synthetic peptide
VIYNT

SEQ ID NO: 335 - protein, 5 aa, Artificial sequence
  Synthetic peptide
IYNTK

SEQ ID NO: 336 - protein, 5 aa, Artificial sequence
  Synthetic peptide
YNTKN

SEQ ID NO: 337 - protein, 5 aa, Artificial sequence
  Synthetic peptide
NTKNS

SEQ ID NO: 338 - protein, 5 aa, Artificial sequence
  Synthetic peptide
TKNSQ

SEQ ID NO: 339 - protein, 5 aa, Artificial sequence
  Synthetic peptide
KNSQP

SEQ ID NO: 340 - protein, 5 aa, Artificial sequence
  Synthetic peptide
NSQPQ

SEQ ID NO: 341 - protein, 5 aa, Artificial sequence
  Synthetic peptide
SQPQC

SEQ ID NO: 342 - protein, 5 aa, Artificial sequence
  Synthetic peptide
QPQCI

SEQ ID NO: 343 - protein, 5 aa, Artificial sequence
  Synthetic peptide
PQCIV

SEQ ID NO: 344 - protein, 5 aa, Artificial sequence
  Synthetic peptide
QCIVC

SEQ ID NO: 345 - protein, 5 aa, Artificial sequence
  Synthetic peptide
CIVCV

SEQ ID NO: 346 - protein, 5 aa, Artificial sequence
  Synthetic peptide
IVCVN

SEQ ID NO: 347 - protein, 5 aa, Artificial sequence
  Synthetic peptide
VCVNY

SEQ ID NO: 348 - protein, 5 aa, Artificial sequence
  Synthetic peptide
CVNYV

SEQ ID NO: 349 - protein, 5 aa, Artificial sequence
  Synthetic peptide
VNYVV

SEQ ID NO: 350 - protein, 5 aa, Artificial sequence
  Synthetic peptide
NYVVS

SEQ ID NO: 351 - protein, 5 aa, Artificial sequence
  Synthetic peptide
YVVSG

SEQ ID NO: 352 - protein, 5 aa, Artificial sequence
  Synthetic peptide
VVSGI

SEQ ID NO: 353 - protein, 5 aa, Artificial sequence
  Synthetic peptide
VSGII

SEQ ID NO: 354 - protein, 5 aa, Artificial sequence
  Synthetic peptide
SGIIQ

SEQ ID NO: 355 - protein, 5 aa, Artificial sequence
  Synthetic peptide
GIIQH

SEQ ID NO: 356 - protein, 5 aa, Artificial sequence
  Synthetic peptide
IIQHD

SEQ ID NO: 357 - protein, 5 aa, Artificial sequence
  Synthetic peptide
IQHDL

SEQ ID NO: 358 - protein, 5 aa, Artificial sequence
  Synthetic peptide
QHDLI

SEQ ID NO: 359 - protein, 5 aa, Artificial sequence
  Synthetic peptide
HDLIF

SEQ ID NO: 360 - protein, 5 aa, Artificial sequence
  Synthetic peptide
DLIFS

SEQ ID NO: 361 - protein, 5 aa, Artificial sequence
  Synthetic peptide
LIFSL

SEQ ID NO: 362 - protein, 5 aa, Artificial sequence
  Synthetic peptide
IFSLQ

SEQ ID NO: 363 - protein, 5 aa, Artificial sequence
  Synthetic peptide
FSLQQ

SEQ ID NO: 364 - protein, 5 aa, Artificial sequence
  Synthetic peptide
SLQQT

SEQ ID NO: 365 - protein, 5 aa, Artificial sequence
  Synthetic peptide
LQQTE

SEQ ID NO: 366 - protein, 5 aa, Artificial sequence
  Synthetic peptide
QQTEC

SEQ ID NO: 367 - protein, 5 aa, Artificial sequence
  Synthetic peptide
QTECV

SEQ ID NO: 368 - protein, 5 aa, Artificial sequence
  Synthetic peptide
TECVL

SEQ ID NO: 369 - protein, 5 aa, Artificial sequence
  Synthetic peptide
ECVLK

SEQ ID NO: 370 - protein, 5 aa, Artificial sequence
  Synthetic peptide
CVLKP

SEQ ID NO: 371 - protein, 5 aa, Artificial sequence
  Synthetic peptide
VLKPV

SEQ ID NO: 372 - protein, 5 aa, Artificial sequence
  Synthetic peptide
LKPVE

SEQ ID NO: 373 - protein, 5 aa, Artificial sequence
  Synthetic peptide
KPVES

SEQ ID NO: 374 - protein, 5 aa, Artificial sequence
  Synthetic peptide
PVESS

SEQ ID NO: 375 - protein, 5 aa, Artificial sequence
  Synthetic peptide
VESSD

SEQ ID NO: 376 - protein, 5 aa, Artificial sequence
  Synthetic peptide
ESSDM

SEQ ID NO: 377 - protein, 5 aa, Artificial sequence
  Synthetic peptide
SSDMK

SEQ ID NO: 378 - protein, 5 aa, Artificial sequence
  Synthetic peptide
SDMKM

SEQ ID NO: 379 - protein, 5 aa, Artificial sequence
  Synthetic peptide
DMKMT

SEQ ID NO: 380 - protein, 5 aa, Artificial sequence
  Synthetic peptide
MKMTQ

SEQ ID NO: 381 - protein, 5 aa, Artificial sequence
  Synthetic peptide
KMTQL

SEQ ID NO: 382 - protein, 5 aa, Artificial sequence
  Synthetic peptide
MTQLF

SEQ ID NO: 383 - protein, 5 aa, Artificial sequence
  Synthetic peptide
TQLFT

SEQ ID NO: 384 - protein, 5 aa, Artificial sequence
  Synthetic peptide
QLFTK

SEQ ID NO: 385 - protein, 5 aa, Artificial sequence
  Synthetic peptide
LFTKV

SEQ ID NO: 386 - protein, 5 aa, Artificial sequence
  Synthetic peptide
FTKVE

SEQ ID NO: 387 - protein, 5 aa, Artificial sequence
  Synthetic peptide
TKVES

SEQ ID NO: 388 - protein, 5 aa, Artificial sequence
  Synthetic peptide
KVESE

SEQ ID NO: 389 - protein, 5 aa, Artificial sequence
  Synthetic peptide
VESED

SEQ ID NO: 390 - protein, 5 aa, Artificial sequence
  Synthetic peptide
ESEDT

SEQ ID NO: 391 - protein, 5 aa, Artificial sequence
  Synthetic peptide
SEDTS

SEQ ID NO: 392 - protein, 5 aa, Artificial sequence
  Synthetic peptide
EDTSS

SEQ ID NO: 393 - protein, 5 aa, Artificial sequence
  Synthetic peptide
DTSSL

SEQ ID NO: 394 - protein, 5 aa, Artificial sequence
  Synthetic peptide
TSSLF

SEQ ID NO: 395 - protein, 5 aa, Artificial sequence
  Synthetic peptide
SSLFD

SEQ ID NO: 396 - protein, 5 aa, Artificial sequence
  Synthetic peptide
SLFDK

SEQ ID NO: 397 - protein, 5 aa, Artificial sequence
  Synthetic peptide
LFDKL

SEQ ID NO: 398 - protein, 5 aa, Artificial sequence
  Synthetic peptide
FDKLK

SEQ ID NO: 399 - protein, 5 aa, Artificial sequence
  Synthetic peptide
DKLKK

SEQ ID NO: 400 - protein, 5 aa, Artificial sequence
  Synthetic peptide
KLKKE

SEQ ID NO: 401 - protein, 5 aa, Artificial sequence
  Synthetic peptide
LKKEP

SEQ ID NO: 402 - protein, 5 aa, Artificial sequence
  Synthetic peptide
KKEPD

SEQ ID NO: 403 - protein, 5 aa, Artificial sequence
  Synthetic peptide
KEPDA

SEQ ID NO: 404 - protein, 5 aa, Artificial sequence
  Synthetic peptide
EPDAL

SEQ ID NO: 405 - protein, 5 aa, Artificial sequence
  Synthetic peptide
PDALT

SEQ ID NO: 406 - protein, 5 aa, Artificial sequence
  Synthetic peptide
DALTL

SEQ ID NO: 407 - protein, 5 aa, Artificial sequence
  Synthetic peptide
ALTLL

SEQ ID NO: 408 - protein, 5 aa, Artificial sequence
  Synthetic peptide
LTLLA

SEQ ID NO: 409 - protein, 5 aa, Artificial sequence
  Synthetic peptide
TLLAP

SEQ ID NO: 410 - protein, 5 aa, Artificial sequence
  Synthetic peptide
LLAPA

SEQ ID NO: 411 - protein, 5 aa, Artificial sequence
  Synthetic peptide
LAPAA

SEQ ID NO: 412 - protein, 5 aa, Artificial sequence
  Synthetic peptide
APAAG

SEQ ID NO: 413 - protein, 5 aa, Artificial sequence
  Synthetic peptide
PAAGD

SEQ ID NO: 414 - protein, 5 aa, Artificial sequence
  Synthetic peptide
AAGDT

SEQ ID NO: 415 - protein, 5 aa, Artificial sequence
  Synthetic peptide
AGDTI

SEQ ID NO: 416 - protein, 5 aa, Artificial sequence
  Synthetic peptide
GDTII

SEQ ID NO: 417 - protein, 5 aa, Artificial sequence
  Synthetic peptide
DTIIS

SEQ ID NO: 418 - protein, 5 aa, Artificial sequence
  Synthetic peptide
TIISL

SEQ ID NO: 419 - protein, 5 aa, Artificial sequence
  Synthetic peptide
IISLD

SEQ ID NO: 420 - protein, 5 aa, Artificial sequence
  Synthetic peptide
ISLDF

SEQ ID NO: 421 - protein, 5 aa, Artificial sequence
  Synthetic peptide
SLDFG

SEQ ID NO: 422 - protein, 5 aa, Artificial sequence
  Synthetic peptide
LDFGS

SEQ ID NO: 423 - protein, 5 aa, Artificial sequence
  Synthetic peptide
DFGSN

SEQ ID NO: 424 - protein, 5 aa, Artificial sequence
  Synthetic peptide
FGSND

SEQ ID NO: 425 - protein, 5 aa, Artificial sequence
  Synthetic peptide
GSNDT

SEQ ID NO: 426 - protein, 5 aa, Artificial sequence
  Synthetic peptide
SNDTE

SEQ ID NO: 427 - protein, 5 aa, Artificial sequence
  Synthetic peptide
NDTET

SEQ ID NO: 428 - protein, 5 aa, Artificial sequence
  Synthetic peptide
DTETD

SEQ ID NO: 429 - protein, 5 aa, Artificial sequence
  Synthetic peptide
TETDD

SEQ ID NO: 430 - protein, 5 aa, Artificial sequence
  Synthetic peptide
ETDDQ

SEQ ID NO: 431 - protein, 5 aa, Artificial sequence
  Synthetic peptide
TDDQQ

SEQ ID NO: 432 - protein, 5 aa, Artificial sequence
  Synthetic peptide
DDQQL

SEQ ID NO: 433 - protein, 5 aa, Artificial sequence
  Synthetic peptide
DQQLE

SEQ ID NO: 434 - protein, 5 aa, Artificial sequence
  Synthetic peptide
QQLEE

SEQ ID NO: 435 - protein, 5 aa, Artificial sequence
  Synthetic peptide
QLEEV

SEQ ID NO: 436 - protein, 5 aa, Artificial sequence
  Synthetic peptide
LEEVP

SEQ ID NO: 437 - protein, 5 aa, Artificial sequence
  Synthetic peptide
EEVPL

SEQ ID NO: 438 - protein, 5 aa, Artificial sequence
  Synthetic peptide
EVPLY

SEQ ID NO: 439 - protein, 5 aa, Artificial sequence
  Synthetic peptide
VPLYN

SEQ ID NO: 440 - protein, 5 aa, Artificial sequence
  Synthetic peptide
PLYND

SEQ ID NO: 441 - protein, 5 aa, Artificial sequence
  Synthetic peptide
LYNDV

SEQ ID NO: 442 - protein, 5 aa, Artificial sequence
  Synthetic peptide
YNDVM

SEQ ID NO: 443 - protein, 5 aa, Artificial sequence
  Synthetic peptide
NDVML

SEQ ID NO: 444 - protein, 5 aa, Artificial sequence
  Synthetic peptide
DVMLP

SEQ ID NO: 445 - protein, 5 aa, Artificial sequence
  Synthetic peptide
VMLPS

SEQ ID NO: 446 - protein, 5 aa, Artificial sequence
  Synthetic peptide
MLPSP

SEQ ID NO: 447 - protein, 5 aa, Artificial sequence
  Synthetic peptide
LPSPN

SEQ ID NO: 448 - protein, 5 aa, Artificial sequence
  Synthetic peptide
PSPNE

SEQ ID NO: 449 - protein, 5 aa, Artificial sequence
  Synthetic peptide
SPNEK

SEQ ID NO: 450 - protein, 5 aa, Artificial sequence
  Synthetic peptide
PNEKL

SEQ ID NO: 451 - protein, 5 aa, Artificial sequence
  Synthetic peptide
NEKLQ

SEQ ID NO: 452 - protein, 5 aa, Artificial sequence
  Synthetic peptide
EKLQN

SEQ ID NO: 453 - protein, 5 aa, Artificial sequence
  Synthetic peptide
KLQNI

SEQ ID NO: 454 - protein, 5 aa, Artificial sequence
  Synthetic peptide
LQNIN

SEQ ID NO: 455 - protein, 5 aa, Artificial sequence
  Synthetic peptide
QNINL

SEQ ID NO: 456 - protein, 5 aa, Artificial sequence
  Synthetic peptide
NINLA

SEQ ID NO: 457 - protein, 5 aa, Artificial sequence
  Synthetic peptide
INLAM

SEQ ID NO: 458 - protein, 5 aa, Artificial sequence
  Synthetic peptide
NLAMS

SEQ ID NO: 459 - protein, 5 aa, Artificial sequence
  Synthetic peptide
LAMSP

SEQ ID NO: 460 - protein, 5 aa, Artificial sequence
  Synthetic peptide
AMSPL

SEQ ID NO: 461 - protein, 5 aa, Artificial sequence
  Synthetic peptide
MSPLP

SEQ ID NO: 462 - protein, 5 aa, Artificial sequence
  Synthetic peptide
SPLPT

SEQ ID NO: 463 - protein, 5 aa, Artificial sequence
  Synthetic peptide
PLPTA

SEQ ID NO: 464 - protein, 5 aa, Artificial sequence
  Synthetic peptide
LPTAE

SEQ ID NO: 465 - protein, 5 aa, Artificial sequence
  Synthetic peptide
PTAET

SEQ ID NO: 466 - protein, 5 aa, Artificial sequence
  Synthetic peptide
TAETP

SEQ ID NO: 467 - protein, 5 aa, Artificial sequence
  Synthetic peptide
AETPK

SEQ ID NO: 468 - protein, 5 aa, Artificial sequence
  Synthetic peptide
ETPKP

SEQ ID NO: 469 - protein, 5 aa, Artificial sequence
  Synthetic peptide
TPKPL

SEQ ID NO: 470 - protein, 5 aa, Artificial sequence
  Synthetic peptide
PKPLR

SEQ ID NO: 471 - protein, 5 aa, Artificial sequence
  Synthetic peptide
KPLRS

SEQ ID NO: 472 - protein, 5 aa, Artificial sequence
  Synthetic peptide
PLRSS

SEQ ID NO: 473 - protein, 5 aa, Artificial sequence
  Synthetic peptide
LRSSA

SEQ ID NO: 474 - protein, 5 aa, Artificial sequence
  Synthetic peptide
RSSAD

SEQ ID NO: 475 - protein, 5 aa, Artificial sequence
  Synthetic peptide
SSADP

SEQ ID NO: 476 - protein, 5 aa, Artificial sequence
  Synthetic peptide
SADPA

SEQ ID NO: 477 - protein, 5 aa, Artificial sequence
  Synthetic peptide
ADPAL

SEQ ID NO: 478 - protein, 5 aa, Artificial sequence
  Synthetic peptide
DPALN

SEQ ID NO: 479 - protein, 5 aa, Artificial sequence
  Synthetic peptide
PALNQ

SEQ ID NO: 480 - protein, 5 aa, Artificial sequence
  Synthetic peptide
ALNQE

SEQ ID NO: 481 - protein, 5 aa, Artificial sequence
  Synthetic peptide
LNQEV

SEQ ID NO: 482 - protein, 5 aa, Artificial sequence
  Synthetic peptide
NQEVA

SEQ ID NO: 483 - protein, 5 aa, Artificial sequence
  Synthetic peptide
QEVAL

SEQ ID NO: 484 - protein, 5 aa, Artificial sequence
  Synthetic peptide
EVALK

SEQ ID NO: 485 - protein, 5 aa, Artificial sequence
  Synthetic peptide
VALKL

SEQ ID NO: 486 - protein, 5 aa, Artificial sequence
  Synthetic peptide
ALKLE

SEQ ID NO: 487 - protein, 5 aa, Artificial sequence
  Synthetic peptide
LKLEP

SEQ ID NO: 488 - protein, 5 aa, Artificial sequence
  Synthetic peptide
KLEPN

SEQ ID NO: 489 - protein, 5 aa, Artificial sequence
  Synthetic peptide
LEPNP

SEQ ID NO: 490 - protein, 5 aa, Artificial sequence
  Synthetic peptide
EPNPE

SEQ ID NO: 491 - protein, 5 aa, Artificial sequence
  Synthetic peptide
PNPES

SEQ ID NO: 492 - protein, 5 aa, Artificial sequence
  Synthetic peptide
NPESL

SEQ ID NO: 493 - protein, 5 aa, Artificial sequence
  Synthetic peptide
PESLE

SEQ ID NO: 494 - protein, 5 aa, Artificial sequence
  Synthetic peptide
ESLEL

SEQ ID NO: 495 - protein, 5 aa, Artificial sequence
  Synthetic peptide
SLELS

SEQ ID NO: 496 - protein, 5 aa, Artificial sequence
  Synthetic peptide
LELSF

SEQ ID NO: 497 - protein, 5 aa, Artificial sequence
  Synthetic peptide
ELSFT

SEQ ID NO: 498 - protein, 5 aa, Artificial sequence
  Synthetic peptide
LSFTM

SEQ ID NO: 499 - protein, 5 aa, Artificial sequence
  Synthetic peptide
SFTMP

SEQ ID NO: 500 - protein, 5 aa, Artificial sequence
  Synthetic peptide
FTMPQ

SEQ ID NO: 501 - protein, 5 aa, Artificial sequence
  Synthetic peptide
TMPQI

SEQ ID NO: 502 - protein, 5 aa, Artificial sequence
  Synthetic peptide
MPQIQ

SEQ ID NO: 503 - protein, 5 aa, Artificial sequence
  Synthetic peptide
PQIQD

SEQ ID NO: 504 - protein, 5 aa, Artificial sequence
  Synthetic peptide
QIQDQ

SEQ ID NO: 505 - protein, 5 aa, Artificial sequence
  Synthetic peptide
IQDQT

SEQ ID NO: 506 - protein, 5 aa, Artificial sequence
  Synthetic peptide
QDQTP

SEQ ID NO: 507 - protein, 5 aa, Artificial sequence
  Synthetic peptide
DQTPS

SEQ ID NO: 508 - protein, 5 aa, Artificial sequence
  Synthetic peptide
QTPSP

SEQ ID NO: 509 - protein, 5 aa, Artificial sequence
  Synthetic peptide
TPSPS

SEQ ID NO: 510 - protein, 5 aa, Artificial sequence
  Synthetic peptide
PSPSD

SEQ ID NO: 511 - protein, 5 aa, Artificial sequence
  Synthetic peptide
SPSDG

SEQ ID NO: 512 - protein, 5 aa, Artificial sequence
  Synthetic peptide
PSDGS

SEQ ID NO: 513 - protein, 5 aa, Artificial sequence
  Synthetic peptide
SDGST

SEQ ID NO: 514 - protein, 5 aa, Artificial sequence
  Synthetic peptide
DGSTR

SEQ ID NO: 515 - protein, 5 aa, Artificial sequence
  Synthetic peptide
GSTRQ

SEQ ID NO: 516 - protein, 5 aa, Artificial sequence
  Synthetic peptide
STRQS

SEQ ID NO: 517 - protein, 5 aa, Artificial sequence
  Synthetic peptide
TRQSS

SEQ ID NO: 518 - protein, 5 aa, Artificial sequence
  Synthetic peptide
RQSSP

SEQ ID NO: 519 - protein, 5 aa, Artificial sequence
  Synthetic peptide
QSSPE

SEQ ID NO: 520 - protein, 5 aa, Artificial sequence
  Synthetic peptide
SSPEP

SEQ ID NO: 521 - protein, 5 aa, Artificial sequence
  Synthetic peptide
SPEPN

SEQ ID NO: 522 - protein, 5 aa, Artificial sequence
  Synthetic peptide
PEPNS

SEQ ID NO: 523 - protein, 5 aa, Artificial sequence
  Synthetic peptide
EPNSP

SEQ ID NO: 524 - protein, 5 aa, Artificial sequence
  Synthetic peptide
PNSPS

SEQ ID NO: 525 - protein, 5 aa, Artificial sequence
  Synthetic peptide
NSPSE

SEQ ID NO: 526 - protein, 5 aa, Artificial sequence
  Synthetic peptide
SPSEY

SEQ ID NO: 527 - protein, 5 aa, Artificial sequence
  Synthetic peptide
PSEYC

SEQ ID NO: 528 - protein, 5 aa, Artificial sequence
  Synthetic peptide
SEYCF

SEQ ID NO: 529 - protein, 5 aa, Artificial sequence
  Synthetic peptide
EYCFY

SEQ ID NO: 530 - protein, 5 aa, Artificial sequence
  Synthetic peptide
YCFYV

SEQ ID NO: 531 - protein, 5 aa, Artificial sequence
  Synthetic peptide
CFYVD

SEQ ID NO: 532 - protein, 5 aa, Artificial sequence
  Synthetic peptide
FYVDS

SEQ ID NO: 533 - protein, 5 aa, Artificial sequence
  Synthetic peptide
YVDSD

SEQ ID NO: 534 - protein, 5 aa, Artificial sequence
  Synthetic peptide
VDSDM

SEQ ID NO: 535 - protein, 5 aa, Artificial sequence
  Synthetic peptide
DSDMV

SEQ ID NO: 536 - protein, 5 aa, Artificial sequence
  Synthetic peptide
SDMVN

SEQ ID NO: 537 - protein, 5 aa, Artificial sequence
  Synthetic peptide
DMVNE

SEQ ID NO: 538 - protein, 5 aa, Artificial sequence
  Synthetic peptide
MVNEF

SEQ ID NO: 539 - protein, 5 aa, Artificial sequence
  Synthetic peptide
VNEFK

SEQ ID NO: 540 - protein, 5 aa, Artificial sequence
  Synthetic peptide
NEFKL

SEQ ID NO: 541 - protein, 5 aa, Artificial sequence
  Synthetic peptide
EFKLE

SEQ ID NO: 542 - protein, 5 aa, Artificial sequence
  Synthetic peptide
FKLEL

SEQ ID NO: 543 - protein, 5 aa, Artificial sequence
  Synthetic peptide
KLELV

SEQ ID NO: 544 - protein, 5 aa, Artificial sequence
  Synthetic peptide
LELVE

SEQ ID NO: 545 - protein, 5 aa, Artificial sequence
  Synthetic peptide
ELVEK

SEQ ID NO: 546 - protein, 5 aa, Artificial sequence
  Synthetic peptide
LVEKL

SEQ ID NO: 547 - protein, 5 aa, Artificial sequence
  Synthetic peptide
VEKLF

SEQ ID NO: 548 - protein, 5 aa, Artificial sequence
  Synthetic peptide
EKLFA

SEQ ID NO: 549 - protein, 5 aa, Artificial sequence
  Synthetic peptide
KLFAE

SEQ ID NO: 550 - protein, 5 aa, Artificial sequence
  Synthetic peptide
LFAED

SEQ ID NO: 551 - protein, 5 aa, Artificial sequence
  Synthetic peptide
FAEDT

SEQ ID NO: 552 - protein, 5 aa, Artificial sequence
  Synthetic peptide
AEDTE

SEQ ID NO: 553 - protein, 5 aa, Artificial sequence
  Synthetic peptide
EDTEA

SEQ ID NO: 554 - protein, 5 aa, Artificial sequence
  Synthetic peptide
DTEAK

SEQ ID NO: 555 - protein, 5 aa, Artificial sequence
  Synthetic peptide
TEAKN

SEQ ID NO: 556 - protein, 5 aa, Artificial sequence
  Synthetic peptide
EAKNP

SEQ ID NO: 557 - protein, 5 aa, Artificial sequence
  Synthetic peptide
AKNPF

SEQ ID NO: 558 - protein, 5 aa, Artificial sequence
  Synthetic peptide
KNPFS

SEQ ID NO: 559 - protein, 5 aa, Artificial sequence
  Synthetic peptide
NPFST

SEQ ID NO: 560 - protein, 5 aa, Artificial sequence
  Synthetic peptide
PFSTQ

SEQ ID NO: 561 - protein, 5 aa, Artificial sequence
  Synthetic peptide
FSTQD

SEQ ID NO: 562 - protein, 5 aa, Artificial sequence
  Synthetic peptide
STQDT

SEQ ID NO: 563 - protein, 5 aa, Artificial sequence
  Synthetic peptide
TQDTD

SEQ ID NO: 564 - protein, 5 aa, Artificial sequence
  Synthetic peptide
QDTDL

SEQ ID NO: 565 - protein, 5 aa, Artificial sequence
  Synthetic peptide
DTDLD

SEQ ID NO: 566 - protein, 5 aa, Artificial sequence
  Synthetic peptide
TDLDL

SEQ ID NO: 567 - protein, 5 aa, Artificial sequence
  Synthetic peptide
DLDLE

SEQ ID NO: 568 - protein, 5 aa, Artificial sequence
  Synthetic peptide
LDLEM

SEQ ID NO: 569 - protein, 5 aa, Artificial sequence
  Synthetic peptide
DLEML

SEQ ID NO: 570 - protein, 5 aa, Artificial sequence
  Synthetic peptide
LEMLA

SEQ ID NO: 571 - protein, 5 aa, Artificial sequence
  Synthetic peptide
EMLAP

SEQ ID NO: 572 - protein, 5 aa, Artificial sequence
  Synthetic peptide
MLAPY

SEQ ID NO: 573 - protein, 5 aa, Artificial sequence
  Synthetic peptide
LAPYI

SEQ ID NO: 574 - protein, 5 aa, Artificial sequence
  Synthetic peptide
APYIP

SEQ ID NO: 575 - protein, 5 aa, Artificial sequence
  Synthetic peptide
PYIPM

SEQ ID NO: 576 - protein, 5 aa, Artificial sequence
  Synthetic peptide
YIPMD

SEQ ID NO: 577 - protein, 5 aa, Artificial sequence
  Synthetic peptide
IPMDD

SEQ ID NO: 578 - protein, 5 aa, Artificial sequence
  Synthetic peptide
PMDDD

SEQ ID NO: 579 - protein, 5 aa, Artificial sequence
  Synthetic peptide
MDDDF

SEQ ID NO: 580 - protein, 5 aa, Artificial sequence
  Synthetic peptide
DDDFQ

SEQ ID NO: 581 - protein, 5 aa, Artificial sequence
  Synthetic peptide
DDFQL

SEQ ID NO: 582 - protein, 5 aa, Artificial sequence
  Synthetic peptide
DFQLR

SEQ ID NO: 583 - protein, 5 aa, Artificial sequence
  Synthetic peptide
FQLRS

SEQ ID NO: 584 - protein, 5 aa, Artificial sequence
  Synthetic peptide
QLRSF

SEQ ID NO: 585 - protein, 5 aa, Artificial sequence
  Synthetic peptide
LRSFD

SEQ ID NO: 586 - protein, 5 aa, Artificial sequence
  Synthetic peptide
RSFDQ

SEQ ID NO: 587 - protein, 5 aa, Artificial sequence
  Synthetic peptide
SFDQL

SEQ ID NO: 588 - protein, 5 aa, Artificial sequence
  Synthetic peptide
FDQLS

SEQ ID NO: 589 - protein, 5 aa, Artificial sequence
  Synthetic peptide
DQLSP

SEQ ID NO: 590 - protein, 5 aa, Artificial sequence
  Synthetic peptide
QLSPL

SEQ ID NO: 591 - protein, 5 aa, Artificial sequence
  Synthetic peptide
LSPLE

SEQ ID NO: 592 - protein, 5 aa, Artificial sequence
  Synthetic peptide
SPLES

SEQ ID NO: 593 - protein, 5 aa, Artificial sequence
  Synthetic peptide
PLESS

SEQ ID NO: 594 - protein, 5 aa, Artificial sequence
  Synthetic peptide
LESSS

SEQ ID NO: 595 - protein, 5 aa, Artificial sequence
  Synthetic peptide
ESSSA

SEQ ID NO: 596 - protein, 5 aa, Artificial sequence
  Synthetic peptide
SSSAS

SEQ ID NO: 597 - protein, 5 aa, Artificial sequence
  Synthetic peptide
SSASP

SEQ ID NO: 598 - protein, 5 aa, Artificial sequence
  Synthetic peptide
SASPE

SEQ ID NO: 599 - protein, 5 aa, Artificial sequence
  Synthetic peptide
ASPES

SEQ ID NO: 600 - protein, 5 aa, Artificial sequence
  Synthetic peptide
SPESA

SEQ ID NO: 601 - protein, 5 aa, Artificial sequence
  Synthetic peptide
PESAS

SEQ ID NO: 602 - protein, 5 aa, Artificial sequence
  Synthetic peptide
ESASP

SEQ ID NO: 603 - protein, 5 aa, Artificial sequence
  Synthetic peptide
SASPQ

SEQ ID NO: 604 - protein, 5 aa, Artificial sequence
  Synthetic peptide
ASPQS

SEQ ID NO: 605 - protein, 5 aa, Artificial sequence
  Synthetic peptide
SPQST

SEQ ID NO: 606 - protein, 5 aa, Artificial sequence
  Synthetic peptide
PQSTV

SEQ ID NO: 607 - protein, 5 aa, Artificial sequence
  Synthetic peptide
QSTVT

SEQ ID NO: 608 - protein, 5 aa, Artificial sequence
  Synthetic peptide
STVTV

SEQ ID NO: 609 - protein, 5 aa, Artificial sequence
  Synthetic peptide
TVTVF

SEQ ID NO: 610 - protein, 5 aa, Artificial sequence
  Synthetic peptide
VTVFQ

SEQ ID NO: 611 - protein, 5 aa, Artificial sequence
  Synthetic peptide
TVFQQ

SEQ ID NO: 612 - protein, 5 aa, Artificial sequence
  Synthetic peptide
VFQQT

SEQ ID NO: 613 - protein, 5 aa, Artificial sequence
  Synthetic peptide
FQQTQ

SEQ ID NO: 614 - protein, 5 aa, Artificial sequence
  Synthetic peptide
QQTQI

SEQ ID NO: 615 - protein, 5 aa, Artificial sequence
  Synthetic peptide
QTQIQ

SEQ ID NO: 616 - protein, 5 aa, Artificial sequence
  Synthetic peptide
TQIQE

SEQ ID NO: 617 - protein, 5 aa, Artificial sequence
  Synthetic peptide
QIQEP

SEQ ID NO: 618 - protein, 5 aa, Artificial sequence
  Synthetic peptide
IQEPT

SEQ ID NO: 619 - protein, 5 aa, Artificial sequence
  Synthetic peptide
QEPTA

SEQ ID NO: 620 - protein, 5 aa, Artificial sequence
  Synthetic peptide
EPTAN

SEQ ID NO: 621 - protein, 5 aa, Artificial sequence
  Synthetic peptide
PTANA

SEQ ID NO: 622 - protein, 5 aa, Artificial sequence
  Synthetic peptide
TANAT

SEQ ID NO: 623 - protein, 5 aa, Artificial sequence
  Synthetic peptide
ANATT

SEQ ID NO: 624 - protein, 5 aa, Artificial sequence
  Synthetic peptide
NATTT

SEQ ID NO: 625 - protein, 5 aa, Artificial sequence
  Synthetic peptide
ATTTT

SEQ ID NO: 626 - protein, 5 aa, Artificial sequence
  Synthetic peptide
TTTTA

SEQ ID NO: 627 - protein, 5 aa, Artificial sequence
  Synthetic peptide
TTTAT

SEQ ID NO: 628 - protein, 5 aa, Artificial sequence
  Synthetic peptide
TTATT

SEQ ID NO: 629 - protein, 5 aa, Artificial sequence
  Synthetic peptide
TATTD

SEQ ID NO: 630 - protein, 5 aa, Artificial sequence
  Synthetic peptide
ATTDE

SEQ ID NO: 631 - protein, 5 aa, Artificial sequence
  Synthetic peptide
TTDEL

SEQ ID NO: 632 - protein, 5 aa, Artificial sequence
  Synthetic peptide
TDELK

SEQ ID NO: 633 - protein, 5 aa, Artificial sequence
  Synthetic peptide
DELKT

SEQ ID NO: 634 - protein, 5 aa, Artificial sequence
  Synthetic peptide
ELKTV

SEQ ID NO: 635 - protein, 5 aa, Artificial sequence
  Synthetic peptide
LKTVT

SEQ ID NO: 636 - protein, 5 aa, Artificial sequence
  Synthetic peptide
KTVTK

SEQ ID NO: 637 - protein, 5 aa, Artificial sequence
  Synthetic peptide
TVTKD

SEQ ID NO: 638 - protein, 5 aa, Artificial sequence
  Synthetic peptide
VTKDR

SEQ ID NO: 639 - protein, 5 aa, Artificial sequence
  Synthetic peptide
TKDRM

SEQ ID NO: 640 - protein, 5 aa, Artificial sequence
  Synthetic peptide
KDRME

SEQ ID NO: 641 - protein, 5 aa, Artificial sequence
  Synthetic peptide
DRMED

SEQ ID NO: 642 - protein, 5 aa, Artificial sequence
  Synthetic peptide
RMEDI

SEQ ID NO: 643 - protein, 5 aa, Artificial sequence
  Synthetic peptide
MEDIK

SEQ ID NO: 644 - protein, 5 aa, Artificial sequence
  Synthetic peptide
EDIKI

SEQ ID NO: 645 - protein, 5 aa, Artificial sequence
  Synthetic peptide
DIKIL

SEQ ID NO: 646 - protein, 5 aa, Artificial sequence
  Synthetic peptide
IKILI

SEQ ID NO: 647 - protein, 5 aa, Artificial sequence
  Synthetic peptide
KILIA

SEQ ID NO: 648 - protein, 5 aa, Artificial sequence
  Synthetic peptide
ILIAS

SEQ ID NO: 649 - protein, 5 aa, Artificial sequence
  Synthetic peptide
LIASP

SEQ ID NO: 650 - protein, 5 aa, Artificial sequence
  Synthetic peptide
IASPS

SEQ ID NO: 651 - protein, 5 aa, Artificial sequence
  Synthetic peptide
ASPSP

SEQ ID NO: 652 - protein, 5 aa, Artificial sequence
  Synthetic peptide
SPSPT

SEQ ID NO: 653 - protein, 5 aa, Artificial sequence
  Synthetic peptide
PSPTH

SEQ ID NO: 654 - protein, 5 aa, Artificial sequence
  Synthetic peptide
SPTHI

SEQ ID NO: 655 - protein, 5 aa, Artificial sequence
  Synthetic peptide
PTHIH

SEQ ID NO: 656 - protein, 5 aa, Artificial sequence
  Synthetic peptide
THIHK

SEQ ID NO: 657 - protein, 5 aa, Artificial sequence
  Synthetic peptide
HIHKE

SEQ ID NO: 658 - protein, 5 aa, Artificial sequence
  Synthetic peptide
IHKET

SEQ ID NO: 659 - protein, 5 aa, Artificial sequence
  Synthetic peptide
HKETT

SEQ ID NO: 660 - protein, 5 aa, Artificial sequence
  Synthetic peptide
KETTS

SEQ ID NO: 661 - protein, 5 aa, Artificial sequence
  Synthetic peptide
ETTSA

SEQ ID NO: 662 - protein, 5 aa, Artificial sequence
  Synthetic peptide
TTSAT

SEQ ID NO: 663 - protein, 5 aa, Artificial sequence
  Synthetic peptide
TSATS

SEQ ID NO: 664 - protein, 5 aa, Artificial sequence
  Synthetic peptide
SATSS

SEQ ID NO: 665 - protein, 5 aa, Artificial sequence
  Synthetic peptide
ATSSP

SEQ ID NO: 666 - protein, 5 aa, Artificial sequence
  Synthetic peptide
TSSPY

SEQ ID NO: 667 - protein, 5 aa, Artificial sequence
  Synthetic peptide
SSPYR

SEQ ID NO: 668 - protein, 5 aa, Artificial sequence
  Synthetic peptide
SPYRD

SEQ ID NO: 669 - protein, 5 aa, Artificial sequence
  Synthetic peptide
PYRDT

SEQ ID NO: 670 - protein, 5 aa, Artificial sequence
  Synthetic peptide
YRDTQ

SEQ ID NO: 671 - protein, 5 aa, Artificial sequence
  Synthetic peptide
RDTQS

SEQ ID NO: 672 - protein, 5 aa, Artificial sequence
  Synthetic peptide
DTQSR

SEQ ID NO: 673 - protein, 5 aa, Artificial sequence
  Synthetic peptide
TQSRT

SEQ ID NO: 674 - protein, 5 aa, Artificial sequence
  Synthetic peptide
QSRTA

SEQ ID NO: 675 - protein, 5 aa, Artificial sequence
  Synthetic peptide
SRTAS

SEQ ID NO: 676 - protein, 5 aa, Artificial sequence
  Synthetic peptide
RTASP

SEQ ID NO: 677 - protein, 5 aa, Artificial sequence
  Synthetic peptide
TASPN

SEQ ID NO: 678 - protein, 5 aa, Artificial sequence
  Synthetic peptide
ASPNR

SEQ ID NO: 679 - protein, 5 aa, Artificial sequence
  Synthetic peptide
SPNRA

SEQ ID NO: 680 - protein, 5 aa, Artificial sequence
  Synthetic peptide
PNRAG

SEQ ID NO: 681 - protein, 5 aa, Artificial sequence
  Synthetic peptide
NRAGK

SEQ ID NO: 682 - protein, 5 aa, Artificial sequence
  Synthetic peptide
RAGKG

SEQ ID NO: 683 - protein, 5 aa, Artificial sequence
  Synthetic peptide
AGKGV

SEQ ID NO: 684 - protein, 5 aa, Artificial sequence
  Synthetic peptide
GKGVI

SEQ ID NO: 685 - protein, 5 aa, Artificial sequence
  Synthetic peptide
KGVIE

SEQ ID NO: 686 - protein, 5 aa, Artificial sequence
  Synthetic peptide
GVIEQ

SEQ ID NO: 687 - protein, 5 aa, Artificial sequence
  Synthetic peptide
VIEQT

SEQ ID NO: 688 - protein, 5 aa, Artificial sequence
  Synthetic peptide
IEQTE

SEQ ID NO: 689 - protein, 5 aa, Artificial sequence
  Synthetic peptide
EQTEK

SEQ ID NO: 690 - protein, 5 aa, Artificial sequence
  Synthetic peptide
QTEKS

SEQ ID NO: 691 - protein, 5 aa, Artificial sequence
  Synthetic peptide
TEKSH

SEQ ID NO: 692 - protein, 5 aa, Artificial sequence
  Synthetic peptide
EKSHP

SEQ ID NO: 693 - protein, 5 aa, Artificial sequence
  Synthetic peptide
KSHPR

SEQ ID NO: 694 - protein, 5 aa, Artificial sequence
  Synthetic peptide
SHPRS

SEQ ID NO: 695 - protein, 5 aa, Artificial sequence
  Synthetic peptide
HPRSP

SEQ ID NO: 696 - protein, 5 aa, Artificial sequence
  Synthetic peptide
PRSPN

SEQ ID NO: 697 - protein, 5 aa, Artificial sequence
  Synthetic peptide
RSPNV

SEQ ID NO: 698 - protein, 5 aa, Artificial sequence
  Synthetic peptide
SPNVL

SEQ ID NO: 699 - protein, 5 aa, Artificial sequence
  Synthetic peptide
PNVLS

SEQ ID NO: 700 - protein, 5 aa, Artificial sequence
  Synthetic peptide
NVLSV

SEQ ID NO: 701 - protein, 5 aa, Artificial sequence
  Synthetic peptide
VLSVA

SEQ ID NO: 702 - protein, 5 aa, Artificial sequence
  Synthetic peptide
LSVAL

SEQ ID NO: 703 - protein, 5 aa, Artificial sequence
  Synthetic peptide
SVALS

SEQ ID NO: 704 - protein, 5 aa, Artificial sequence
  Synthetic peptide
VALSQ

SEQ ID NO: 705 - protein, 5 aa, Artificial sequence
  Synthetic peptide
ALSQR

SEQ ID NO: 706 - protein, 5 aa, Artificial sequence
  Synthetic peptide
LSQRT

SEQ ID NO: 707 - protein, 5 aa, Artificial sequence
  Synthetic peptide
SQRTT

SEQ ID NO: 708 - protein, 5 aa, Artificial sequence
  Synthetic peptide
QRTTV

SEQ ID NO: 709 - protein, 5 aa, Artificial sequence
  Synthetic peptide
RTTVP

SEQ ID NO: 710 - protein, 5 aa, Artificial sequence
  Synthetic peptide
TTVPE

SEQ ID NO: 711 - protein, 5 aa, Artificial sequence
  Synthetic peptide
TVPEE

SEQ ID NO: 712 - protein, 5 aa, Artificial sequence
  Synthetic peptide
VPEEE

SEQ ID NO: 713 - protein, 5 aa, Artificial sequence
  Synthetic peptide
PEEEL

SEQ ID NO: 714 - protein, 5 aa, Artificial sequence
  Synthetic peptide
EEELN

SEQ ID NO: 715 - protein, 5 aa, Artificial sequence
  Synthetic peptide
EELNP

SEQ ID NO: 716 - protein, 5 aa, Artificial sequence
  Synthetic peptide
ELNPK

SEQ ID NO: 717 - protein, 5 aa, Artificial sequence
  Synthetic peptide
LNPKI

SEQ ID NO: 718 - protein, 5 aa, Artificial sequence
  Synthetic peptide
NPKIL

SEQ ID NO: 719 - protein, 5 aa, Artificial sequence
  Synthetic peptide
PKILA

SEQ ID NO: 720 - protein, 5 aa, Artificial sequence
  Synthetic peptide
KILAL

SEQ ID NO: 721 - protein, 5 aa, Artificial sequence
  Synthetic peptide
ILALQ

SEQ ID NO: 722 - protein, 5 aa, Artificial sequence
  Synthetic peptide
LALQN

SEQ ID NO: 723 - protein, 5 aa, Artificial sequence
  Synthetic peptide
ALQNA

SEQ ID NO: 724 - protein, 5 aa, Artificial sequence
  Synthetic peptide
LQNAQ

SEQ ID NO: 725 - protein, 5 aa, Artificial sequence
  Synthetic peptide
QNAQR

SEQ ID NO: 726 - protein, 5 aa, Artificial sequence
  Synthetic peptide
NAQRK

SEQ ID NO: 727 - protein, 5 aa, Artificial sequence
  Synthetic peptide
AQRKR

SEQ ID NO: 728 - protein, 5 aa, Artificial sequence
  Synthetic peptide
QRKRK

SEQ ID NO: 729 - protein, 5 aa, Artificial sequence
  Synthetic peptide
RKRKM

SEQ ID NO: 730 - protein, 5 aa, Artificial sequence
  Synthetic peptide
KRKME

SEQ ID NO: 731 - protein, 5 aa, Artificial sequence
  Synthetic peptide
RKMEH

SEQ ID NO: 732 - protein, 5 aa, Artificial sequence
  Synthetic peptide
KMEHD

SEQ ID NO: 733 - protein, 5 aa, Artificial sequence
  Synthetic peptide
MEHDG

SEQ ID NO: 734 - protein, 5 aa, Artificial sequence
  Synthetic peptide
EHDGS

SEQ ID NO: 735 - protein, 5 aa, Artificial sequence
  Synthetic peptide
HDGSL

SEQ ID NO: 736 - protein, 5 aa, Artificial sequence
  Synthetic peptide
DGSLF

SEQ ID NO: 737 - protein, 5 aa, Artificial sequence
  Synthetic peptide
GSLFQ

SEQ ID NO: 738 - protein, 5 aa, Artificial sequence
  Synthetic peptide
SLFQA

SEQ ID NO: 739 - protein, 5 aa, Artificial sequence
  Synthetic peptide
LFQAV

SEQ ID NO: 740 - protein, 5 aa, Artificial sequence
  Synthetic peptide
FQAVG

SEQ ID NO: 741 - protein, 5 aa, Artificial sequence
  Synthetic peptide
QAVGI

SEQ ID NO: 742 - protein, 5 aa, Artificial sequence
  Synthetic peptide
AVGIG

SEQ ID NO: 743 - protein, 5 aa, Artificial sequence
  Synthetic peptide
VGIGT

SEQ ID NO: 744 - protein, 5 aa, Artificial sequence
  Synthetic peptide
GIGTL

SEQ ID NO: 745 - protein, 5 aa, Artificial sequence
  Synthetic peptide
IGTLL

SEQ ID NO: 746 - protein, 5 aa, Artificial sequence
  Synthetic peptide
GTLLQ

SEQ ID NO: 747 - protein, 5 aa, Artificial sequence
  Synthetic peptide
TLLQQ

SEQ ID NO: 748 - protein, 5 aa, Artificial sequence
  Synthetic peptide
LLQQP

SEQ ID NO: 749 - protein, 5 aa, Artificial sequence
  Synthetic peptide
LQQPD

SEQ ID NO: 750 - protein, 5 aa, Artificial sequence
  Synthetic peptide
QQPDD

SEQ ID NO: 751 - protein, 5 aa, Artificial sequence
  Synthetic peptide
QPDDH

SEQ ID NO: 752 - protein, 5 aa, Artificial sequence
  Synthetic peptide
PDDHA

SEQ ID NO: 753 - protein, 5 aa, Artificial sequence
  Synthetic peptide
DDHAA

SEQ ID NO: 754 - protein, 5 aa, Artificial sequence
  Synthetic peptide
DHAAT

SEQ ID NO: 755 - protein, 5 aa, Artificial sequence
  Synthetic peptide
HAATT

SEQ ID NO: 756 - protein, 5 aa, Artificial sequence
  Synthetic peptide
AATTS

SEQ ID NO: 757 - protein, 5 aa, Artificial sequence
  Synthetic peptide
ATTSL

SEQ ID NO: 758 - protein, 5 aa, Artificial sequence
  Synthetic peptide
TTSLS

SEQ ID NO: 759 - protein, 5 aa, Artificial sequence
  Synthetic peptide
TSLSW

SEQ ID NO: 760 - protein, 5 aa, Artificial sequence
  Synthetic peptide
SLSWK

SEQ ID NO: 761 - protein, 5 aa, Artificial sequence
  Synthetic peptide
LSWKR

SEQ ID NO: 762 - protein, 5 aa, Artificial sequence
  Synthetic peptide
SWKRV

SEQ ID NO: 763 - protein, 5 aa, Artificial sequence
  Synthetic peptide
WKRVK

SEQ ID NO: 764 - protein, 5 aa, Artificial sequence
  Synthetic peptide
KRVKG

SEQ ID NO: 765 - protein, 5 aa, Artificial sequence
  Synthetic peptide
RVKGC

SEQ ID NO: 766 - protein, 5 aa, Artificial sequence
  Synthetic peptide
VKGCK

SEQ ID NO: 767 - protein, 5 aa, Artificial sequence
  Synthetic peptide
KGCKS

SEQ ID NO: 768 - protein, 5 aa, Artificial sequence
  Synthetic peptide
GCKSS

SEQ ID NO: 769 - protein, 5 aa, Artificial sequence
  Synthetic peptide
CKSSE

SEQ ID NO: 770 - protein, 5 aa, Artificial sequence
  Synthetic peptide
KSSEQ

SEQ ID NO: 771 - protein, 5 aa, Artificial sequence
  Synthetic peptide
SSEQN

SEQ ID NO: 772 - protein, 5 aa, Artificial sequence
  Synthetic peptide
SEQNG

SEQ ID NO: 773 - protein, 5 aa, Artificial sequence
  Synthetic peptide
EQNGM

SEQ ID NO: 774 - protein, 5 aa, Artificial sequence
  Synthetic peptide
QNGME

SEQ ID NO: 775 - protein, 5 aa, Artificial sequence
  Synthetic peptide
NGMEQ

SEQ ID NO: 776 - protein, 5 aa, Artificial sequence
  Synthetic peptide
GMEQK

SEQ ID NO: 777 - protein, 5 aa, Artificial sequence
  Synthetic peptide
MEQKT

SEQ ID NO: 778 - protein, 5 aa, Artificial sequence
  Synthetic peptide
EQKTI

SEQ ID NO: 779 - protein, 5 aa, Artificial sequence
  Synthetic peptide
QKTII

SEQ ID NO: 780 - protein, 5 aa, Artificial sequence
  Synthetic peptide
KTIIL

SEQ ID NO: 781 - protein, 5 aa, Artificial sequence
  Synthetic peptide
TIILI

SEQ ID NO: 782 - protein, 5 aa, Artificial sequence
  Synthetic peptide
IILIP

SEQ ID NO: 783 - protein, 5 aa, Artificial sequence
  Synthetic peptide
ILIPS

SEQ ID NO: 784 - protein, 5 aa, Artificial sequence
  Synthetic peptide
LIPSD

SEQ ID NO: 785 - protein, 5 aa, Artificial sequence
  Synthetic peptide
IPSDL

SEQ ID NO: 786 - protein, 5 aa, Artificial sequence
  Synthetic peptide
PSDLA

SEQ ID NO: 787 - protein, 5 aa, Artificial sequence
  Synthetic peptide
SDLAC

SEQ ID NO: 788 - protein, 5 aa, Artificial sequence
  Synthetic peptide
DLACR

SEQ ID NO: 789 - protein, 5 aa, Artificial sequence
  Synthetic peptide
LACRL

SEQ ID NO: 790 - protein, 5 aa, Artificial sequence
  Synthetic peptide
ACRLL

SEQ ID NO: 791 - protein, 5 aa, Artificial sequence
  Synthetic peptide
CRLLG

SEQ ID NO: 792 - protein, 5 aa, Artificial sequence
  Synthetic peptide
RLLGQ

SEQ ID NO: 793 - protein, 5 aa, Artificial sequence
  Synthetic peptide
LLGQS

SEQ ID NO: 794 - protein, 5 aa, Artificial sequence
  Synthetic peptide
LGQSM

SEQ ID NO: 795 - protein, 5 aa, Artificial sequence
  Synthetic peptide
GQSMD

SEQ ID NO: 796 - protein, 5 aa, Artificial sequence
  Synthetic peptide
QSMDE

SEQ ID NO: 797 - protein, 5 aa, Artificial sequence
  Synthetic peptide
SMDES

SEQ ID NO: 798 - protein, 5 aa, Artificial sequence
  Synthetic peptide
MDESG

SEQ ID NO: 799 - protein, 5 aa, Artificial sequence
  Synthetic peptide
DESGL

SEQ ID NO: 800 - protein, 5 aa, Artificial sequence
  Synthetic peptide
ESGLP

SEQ ID NO: 801 - protein, 5 aa, Artificial sequence
  Synthetic peptide
SGLPQ

SEQ ID NO: 802 - protein, 5 aa, Artificial sequence
  Synthetic peptide
GLPQL

SEQ ID NO: 803 - protein, 5 aa, Artificial sequence
  Synthetic peptide
LPQLT

SEQ ID NO: 804 - protein, 5 aa, Artificial sequence
  Synthetic peptide
PQLTS

SEQ ID NO: 805 - protein, 5 aa, Artificial sequence
  Synthetic peptide
QLTSY

SEQ ID NO: 806 - protein, 5 aa, Artificial sequence
  Synthetic peptide
LTSYD

SEQ ID NO: 807 - protein, 5 aa, Artificial sequence
  Synthetic peptide
TSYDC

SEQ ID NO: 808 - protein, 5 aa, Artificial sequence
  Synthetic peptide
SYDCE

SEQ ID NO: 809 - protein, 5 aa, Artificial sequence
  Synthetic peptide
YDCEV

SEQ ID NO: 810 - protein, 5 aa, Artificial sequence
  Synthetic peptide
DCEVN

SEQ ID NO: 811 - protein, 5 aa, Artificial sequence
  Synthetic peptide
CEVNA

SEQ ID NO: 812 - protein, 5 aa, Artificial sequence
  Synthetic peptide
EVNAP

SEQ ID NO: 813 - protein, 5 aa, Artificial sequence
  Synthetic peptide
VNAPI

SEQ ID NO: 814 - protein, 5 aa, Artificial sequence
  Synthetic peptide
NAPIQ

SEQ ID NO: 815 - protein, 5 aa, Artificial sequence
  Synthetic peptide
APIQG

SEQ ID NO: 816 - protein, 5 aa, Artificial sequence
  Synthetic peptide
PIQGS

SEQ ID NO: 817 - protein, 5 aa, Artificial sequence
  Synthetic peptide
IQGSR

SEQ ID NO: 818 - protein, 5 aa, Artificial sequence
  Synthetic peptide
QGSRN

SEQ ID NO: 819 - protein, 5 aa, Artificial sequence
  Synthetic peptide
GSRNL

SEQ ID NO: 820 - protein, 5 aa, Artificial sequence
  Synthetic peptide
SRNLL

SEQ ID NO: 821 - protein, 5 aa, Artificial sequence
  Synthetic peptide
RNLLQ

SEQ ID NO: 822 - protein, 5 aa, Artificial sequence
  Synthetic peptide
NLLQG

SEQ ID NO: 823 - protein, 5 aa, Artificial sequence
  Synthetic peptide
LLQGE

SEQ ID NO: 824 - protein, 5 aa, Artificial sequence
  Synthetic peptide
LQGEE

SEQ ID NO: 825 - protein, 5 aa, Artificial sequence
  Synthetic peptide
QGEEL

SEQ ID NO: 826 - protein, 5 aa, Artificial sequence
  Synthetic peptide
GEELL

SEQ ID NO: 827 - protein, 5 aa, Artificial sequence
  Synthetic peptide
EELLR

SEQ ID NO: 828 - protein, 5 aa, Artificial sequence
  Synthetic peptide
ELLRA

SEQ ID NO: 829 - protein, 5 aa, Artificial sequence
  Synthetic peptide
LLRAL

SEQ ID NO: 830 - protein, 5 aa, Artificial sequence
  Synthetic peptide
LRALD

SEQ ID NO: 831 - protein, 5 aa, Artificial sequence
  Synthetic peptide
RALDQ

SEQ ID NO: 832 - protein, 5 aa, Artificial sequence
  Synthetic peptide
ALDQV

SEQ ID NO: 833 - protein, 5 aa, Artificial sequence
  Synthetic peptide
LDQVN

SEQ ID NO: 834 - protein, 10 aa, Artificial sequence
  Synthetic peptide
MEGAGGANDK

SEQ ID NO: 835 - protein, 10 aa, Artificial sequence
  Synthetic peptide
EGAGGANDKK

SEQ ID NO: 836 - protein, 10 aa, Artificial sequence
  Synthetic peptide
GAGGANDKKK

SEQ ID NO: 837 - protein, 10 aa, Artificial sequence
  Synthetic peptide
AGGANDKKKI

SEQ ID NO: 838 - protein, 10 aa, Artificial sequence
  Synthetic peptide
GGANDKKKIS

SEQ ID NO: 839 - protein, 10 aa, Artificial sequence
  Synthetic peptide
GANDKKKISS

SEQ ID NO: 840 - protein, 10 aa, Artificial sequence
  Synthetic peptide
ANDKKKISSE

SEQ ID NO: 841 - protein, 10 aa, Artificial sequence
  Synthetic peptide
NDKKKISSER

SEQ ID NO: 842 - protein, 10 aa, Artificial sequence
  Synthetic peptide
DKKKISSERR

SEQ ID NO: 843 - protein, 10 aa, Artificial sequence
  Synthetic peptide
KKKISSERRK

SEQ ID NO: 844 - protein, 10 aa, Artificial sequence
  Synthetic peptide
KKISSERRKE

SEQ ID NO: 845 - protein, 10 aa, Artificial sequence
  Synthetic peptide
KISSERRKEK

SEQ ID NO: 846 - protein, 10 aa, Artificial sequence
  Synthetic peptide
ISSERRKEKS

SEQ ID NO: 847 - protein, 10 aa, Artificial sequence
  Synthetic peptide
SSERRKEKSR

SEQ ID NO: 848 - protein, 10 aa, Artificial sequence
  Synthetic peptide
SERRKEKSRD

SEQ ID NO: 849 - protein, 10 aa, Artificial sequence
  Synthetic peptide
ERRKEKSRDA

SEQ ID NO: 850 - protein, 10 aa, Artificial sequence
  Synthetic peptide
RRKEKSRDAA

SEQ ID NO: 851 - protein, 10 aa, Artificial sequence
  Synthetic peptide
RKEKSRDAAR

SEQ ID NO: 852 - protein, 10 aa, Artificial sequence
  Synthetic peptide
KEKSRDAARS

SEQ ID NO: 853 - protein, 10 aa, Artificial sequence
  Synthetic peptide
EKSRDAARSR

SEQ ID NO: 854 - protein, 10 aa, Artificial sequence
  Synthetic peptide
KSRDAARSRR

SEQ ID NO: 855 - protein, 10 aa, Artificial sequence
  Synthetic peptide
SRDAARSRRS

SEQ ID NO: 856 - protein, 10 aa, Artificial sequence
  Synthetic peptide
RDAARSRRSK

SEQ ID NO: 857 - protein, 10 aa, Artificial sequence
  Synthetic peptide
DAARSRRSKE

SEQ ID NO: 858 - protein, 10 aa, Artificial sequence
  Synthetic peptide
AARSRRSKES

SEQ ID NO: 859 - protein, 10 aa, Artificial sequence
  Synthetic peptide
ARSRRSKESE

SEQ ID NO: 860 - protein, 10 aa, Artificial sequence
  Synthetic peptide
RSRRSKESEV

SEQ ID NO: 861 - protein, 10 aa, Artificial sequence
  Synthetic peptide
SRRSKESEVF

SEQ ID NO: 862 - protein, 10 aa, Artificial sequence
  Synthetic peptide
RRSKESEVFY

SEQ ID NO: 863 - protein, 10 aa, Artificial sequence
  Synthetic peptide
RSKESEVFYE

SEQ ID NO: 864 - protein, 10 aa, Artificial sequence
  Synthetic peptide
SKESEVFYEL

SEQ ID NO: 865 - protein, 10 aa, Artificial sequence
  Synthetic peptide
KESEVFYELA

SEQ ID NO: 866 - protein, 10 aa, Artificial sequence
  Synthetic peptide
ESEVFYELAH

SEQ ID NO: 867 - protein, 10 aa, Artificial sequence
  Synthetic peptide
SEVFYELAHQ

SEQ ID NO: 868 - protein, 10 aa, Artificial sequence
  Synthetic peptide
EVFYELAHQL

SEQ ID NO: 869 - protein, 10 aa, Artificial sequence
  Synthetic peptide
VFYELAHQLP

SEQ ID NO: 870 - protein, 10 aa, Artificial sequence
  Synthetic peptide
FYELAHQLPL

SEQ ID NO: 871 - protein, 10 aa, Artificial sequence
  Synthetic peptide
YELAHQLPLP

SEQ ID NO: 872 - protein, 10 aa, Artificial sequence
  Synthetic peptide
ELAHQLPLPH

SEQ ID NO: 873 - protein, 10 aa, Artificial sequence
  Synthetic peptide
LAHQLPLPHN

SEQ ID NO: 874 - protein, 10 aa, Artificial sequence
  Synthetic peptide
AHQLPLPHNV

SEQ ID NO: 875 - protein, 10 aa, Artificial sequence
  Synthetic peptide
HQLPLPHNVS

SEQ ID NO: 876 - protein, 10 aa, Artificial sequence
  Synthetic peptide
QLPLPHNVSS

SEQ ID NO: 877 - protein, 10 aa, Artificial sequence
  Synthetic peptide
LPLPHNVSSH

SEQ ID NO: 878 - protein, 10 aa, Artificial sequence
  Synthetic peptide
PLPHNVSSHL

SEQ ID NO: 879 - protein, 10 aa, Artificial sequence
  Synthetic peptide
LPHNVSSHLD

SEQ ID NO: 880 - protein, 10 aa, Artificial sequence
  Synthetic peptide
PHNVSSHLDK

SEQ ID NO: 881 - protein, 10 aa, Artificial sequence
  Synthetic peptide
HNVSSHLDKA

SEQ ID NO: 882 - protein, 10 aa, Artificial sequence
  Synthetic peptide
NVSSHLDKAS

SEQ ID NO: 883 - protein, 10 aa, Artificial sequence
  Synthetic peptide
VSSHLDKASV

SEQ ID NO: 884 - protein, 10 aa, Artificial sequence
  Synthetic peptide
SSHLDKASVM

SEQ ID NO: 885 - protein, 10 aa, Artificial sequence
  Synthetic peptide
SHLDKASVMR

SEQ ID NO: 886 - protein, 10 aa, Artificial sequence
  Synthetic peptide
HLDKASVMRL

SEQ ID NO: 887 - protein, 10 aa, Artificial sequence
  Synthetic peptide
LDKASVMRLT

SEQ ID NO: 888 - protein, 10 aa, Artificial sequence
  Synthetic peptide
DKASVMRLTI

SEQ ID NO: 889 - protein, 10 aa, Artificial sequence
  Synthetic peptide
KASVMRLTIS

SEQ ID NO: 890 - protein, 10 aa, Artificial sequence
  Synthetic peptide
ASVMRLTISY

SEQ ID NO: 891 - protein, 10 aa, Artificial sequence
  Synthetic peptide
SVMRLTISYL

SEQ ID NO: 892 - protein, 10 aa, Artificial sequence
  Synthetic peptide
VMRLTISYLR

SEQ ID NO: 893 - protein, 10 aa, Artificial sequence
  Synthetic peptide
MRLTISYLRV

SEQ ID NO: 894 - protein, 10 aa, Artificial sequence
  Synthetic peptide
RLTISYLRVR

SEQ ID NO: 895 - protein, 10 aa, Artificial sequence
  Synthetic peptide
LTISYLRVRK

SEQ ID NO: 896 - protein, 10 aa, Artificial sequence
  Synthetic peptide
TISYLRVRKL

SEQ ID NO: 897 - protein, 10 aa, Artificial sequence
  Synthetic peptide
ISYLRVRKLL

SEQ ID NO: 898 - protein, 10 aa, Artificial sequence
  Synthetic peptide
SYLRVRKLLD

SEQ ID NO: 899 - protein, 10 aa, Artificial sequence
  Synthetic peptide
YLRVRKLLDA

SEQ ID NO: 900 - protein, 10 aa, Artificial sequence
  Synthetic peptide
LRVRKLLDAG

SEQ ID NO: 901 - protein, 10 aa, Artificial sequence
  Synthetic peptide
RVRKLLDAGD

SEQ ID NO: 902 - protein, 10 aa, Artificial sequence
  Synthetic peptide
VRKLLDAGDL

SEQ ID NO: 903 - protein, 10 aa, Artificial sequence
  Synthetic peptide
RKLLDAGDLD

SEQ ID NO: 904 - protein, 10 aa, Artificial sequence
  Synthetic peptide
KLLDAGDLDI

SEQ ID NO: 905 - protein, 10 aa, Artificial sequence
  Synthetic peptide
LLDAGDLDIE

SEQ ID NO: 906 - protein, 10 aa, Artificial sequence
  Synthetic peptide
LDAGDLDIED

SEQ ID NO: 907 - protein, 10 aa, Artificial sequence
  Synthetic peptide
DAGDLDIEDD

SEQ ID NO: 908 - protein, 10 aa, Artificial sequence
  Synthetic peptide
AGDLDIEDDM

SEQ ID NO: 909 - protein, 10 aa, Artificial sequence
  Synthetic peptide
GDLDIEDDMK

SEQ ID NO: 910 - protein, 10 aa, Artificial sequence
  Synthetic peptide
DLDIEDDMKA

SEQ ID NO: 911 - protein, 10 aa, Artificial sequence
  Synthetic peptide
LDIEDDMKAQ

SEQ ID NO: 912 - protein, 10 aa, Artificial sequence
  Synthetic peptide
DIEDDMKAQM

SEQ ID NO: 913 - protein, 10 aa, Artificial sequence
  Synthetic peptide
IEDDMKAQMN

SEQ ID NO: 914 - protein, 10 aa, Artificial sequence
  Synthetic peptide
EDDMKAQMNC

SEQ ID NO: 915 - protein, 10 aa, Artificial sequence
  Synthetic peptide
DDMKAQMNCF

SEQ ID NO: 916 - protein, 10 aa, Artificial sequence
  Synthetic peptide
DMKAQMNCFY

SEQ ID NO: 917 - protein, 10 aa, Artificial sequence
  Synthetic peptide
MKAQMNCFYL

SEQ ID NO: 918 - protein, 10 aa, Artificial sequence
  Synthetic peptide
KAQMNCFYLK

SEQ ID NO: 919 - protein, 10 aa, Artificial sequence
  Synthetic peptide
AQMNCFYLKA

SEQ ID NO: 920 - protein, 10 aa, Artificial sequence
  Synthetic peptide
QMNCFYLKAL

SEQ ID NO: 921 - protein, 10 aa, Artificial sequence
  Synthetic peptide
MNCFYLKALD

SEQ ID NO: 922 - protein, 10 aa, Artificial sequence
  Synthetic peptide
NCFYLKALDG

SEQ ID NO: 923 - protein, 10 aa, Artificial sequence
  Synthetic peptide
CFYLKALDGF

SEQ ID NO: 924 - protein, 10 aa, Artificial sequence
  Synthetic peptide
FYLKALDGFV

SEQ ID NO: 925 - protein, 10 aa, Artificial sequence
  Synthetic peptide
YLKALDGFVM

SEQ ID NO: 926 - protein, 10 aa, Artificial sequence
  Synthetic peptide
LKALDGFVMV

SEQ ID NO: 927 - protein, 10 aa, Artificial sequence
  Synthetic peptide
KALDGFVMVL

SEQ ID NO: 928 - protein, 10 aa, Artificial sequence
  Synthetic peptide
ALDGFVMVLT

SEQ ID NO: 929 - protein, 10 aa, Artificial sequence
  Synthetic peptide
LDGFVMVLTD

SEQ ID NO: 930 - protein, 10 aa, Artificial sequence
  Synthetic peptide
DGFVMVLTDD

SEQ ID NO: 931 - protein, 10 aa, Artificial sequence
  Synthetic peptide
GFVMVLTDDG

SEQ ID NO: 932 - protein, 10 aa, Artificial sequence
  Synthetic peptide
FVMVLTDDGD

SEQ ID NO: 933 - protein, 10 aa, Artificial sequence
  Synthetic peptide
VMVLTDDGDM

SEQ ID NO: 934 - protein, 10 aa, Artificial sequence
  Synthetic peptide
MVLTDDGDMI

SEQ ID NO: 935 - protein, 10 aa, Artificial sequence
  Synthetic peptide
VLTDDGDMIY

SEQ ID NO: 936 - protein, 10 aa, Artificial sequence
  Synthetic peptide
LTDDGDMIYI

SEQ ID NO: 937 - protein, 10 aa, Artificial sequence
  Synthetic peptide
TDDGDMIYIS

SEQ ID NO: 938 - protein, 10 aa, Artificial sequence
  Synthetic peptide
DDGDMIYISD

SEQ ID NO: 939 - protein, 10 aa, Artificial sequence
  Synthetic peptide
DGDMIYISDN

SEQ ID NO: 940 - protein, 10 aa, Artificial sequence
  Synthetic peptide
GDMIYISDNV

SEQ ID NO: 941 - protein, 10 aa, Artificial sequence
  Synthetic peptide
DMIYISDNVN

SEQ ID NO: 942 - protein, 10 aa, Artificial sequence
  Synthetic peptide
MIYISDNVNK

SEQ ID NO: 943 - protein, 10 aa, Artificial sequence
  Synthetic peptide
IYISDNVNKY

SEQ ID NO: 944 - protein, 10 aa, Artificial sequence
  Synthetic peptide
YISDNVNKYM

SEQ ID NO: 945 - protein, 10 aa, Artificial sequence
  Synthetic peptide
ISDNVNKYMG

SEQ ID NO: 946 - protein, 10 aa, Artificial sequence
  Synthetic peptide
SDNVNKYMGL

SEQ ID NO: 947 - protein, 10 aa, Artificial sequence
  Synthetic peptide
DNVNKYMGLT

SEQ ID NO: 948 - protein, 10 aa, Artificial sequence
  Synthetic peptide
NVNKYMGLTQ

SEQ ID NO: 949 - protein, 10 aa, Artificial sequence
  Synthetic peptide
VNKYMGLTQF

SEQ ID NO: 950 - protein, 10 aa, Artificial sequence
  Synthetic peptide
NKYMGLTQFE

SEQ ID NO: 951 - protein, 10 aa, Artificial sequence
  Synthetic peptide
KYMGLTQFEL

SEQ ID NO: 952 - protein, 10 aa, Artificial sequence
  Synthetic peptide
YMGLTQFELT

SEQ ID NO: 953 - protein, 10 aa, Artificial sequence
  Synthetic peptide
MGLTQFELTG

SEQ ID NO: 954 - protein, 10 aa, Artificial sequence
  Synthetic peptide
GLTQFELTGH

SEQ ID NO: 955 - protein, 10 aa, Artificial sequence
  Synthetic peptide
LTQFELTGHS

SEQ ID NO: 956 - protein, 10 aa, Artificial sequence
  Synthetic peptide
TQFELTGHSV

SEQ ID NO: 957 - protein, 10 aa, Artificial sequence
  Synthetic peptide
QFELTGHSVF

SEQ ID NO: 958 - protein, 10 aa, Artificial sequence
  Synthetic peptide
FELTGHSVFD

SEQ ID NO: 959 - protein, 10 aa, Artificial sequence
  Synthetic peptide
ELTGHSVFDF

SEQ ID NO: 960 - protein, 10 aa, Artificial sequence
  Synthetic peptide
LTGHSVFDFT

SEQ ID NO: 961 - protein, 10 aa, Artificial sequence
  Synthetic peptide
TGHSVFDFTH

SEQ ID NO: 962 - protein, 10 aa, Artificial sequence
  Synthetic peptide
GHSVFDFTHP

SEQ ID NO: 963 - protein, 10 aa, Artificial sequence
  Synthetic peptide
HSVFDFTHPC

SEQ ID NO: 964 - protein, 10 aa, Artificial sequence
  Synthetic peptide
SVFDFTHPCD

SEQ ID NO: 965 - protein, 10 aa, Artificial sequence
  Synthetic peptide
VFDFTHPCDH

SEQ ID NO: 966 - protein, 10 aa, Artificial sequence
  Synthetic peptide
FDFTHPCDHE

SEQ ID NO: 967 - protein, 10 aa, Artificial sequence
  Synthetic peptide
DFTHPCDHEE

SEQ ID NO: 968 - protein, 10 aa, Artificial sequence
  Synthetic peptide
FTHPCDHEEM

SEQ ID NO: 969 - protein, 10 aa, Artificial sequence
  Synthetic peptide
THPCDHEEMR

SEQ ID NO: 970 - protein, 10 aa, Artificial sequence
  Synthetic peptide
HPCDHEEMRE

SEQ ID NO: 971 - protein, 10 aa, Artificial sequence
  Synthetic peptide
PCDHEEMREM

SEQ ID NO: 972 - protein, 10 aa, Artificial sequence
  Synthetic peptide
CDHEEMREML

SEQ ID NO: 973 - protein, 10 aa, Artificial sequence
  Synthetic peptide
DHEEMREMLT

SEQ ID NO: 974 - protein, 10 aa, Artificial sequence
  Synthetic peptide
HEEMREMLTH

SEQ ID NO: 975 - protein, 10 aa, Artificial sequence
  Synthetic peptide
EEMREMLTHR

SEQ ID NO: 976 - protein, 10 aa, Artificial sequence
  Synthetic peptide
EMREMLTHRN

SEQ ID NO: 977 - protein, 10 aa, Artificial sequence
  Synthetic peptide
MREMLTHRNG

SEQ ID NO: 978 - protein, 10 aa, Artificial sequence
  Synthetic peptide
REMLTHRNGL

SEQ ID NO: 979 - protein, 10 aa, Artificial sequence
  Synthetic peptide
EMLTHRNGLV

SEQ ID NO: 980 - protein, 10 aa, Artificial sequence
  Synthetic peptide
MLTHRNGLVK

SEQ ID NO: 981 - protein, 10 aa, Artificial sequence
  Synthetic peptide
LTHRNGLVKK

SEQ ID NO: 982 - protein, 10 aa, Artificial sequence
  Synthetic peptide
THRNGLVKKG

SEQ ID NO: 983 - protein, 10 aa, Artificial sequence
  Synthetic peptide
HRNGLVKKGK

SEQ ID NO: 984 - protein, 10 aa, Artificial sequence
  Synthetic peptide
RNGLVKKGKE

SEQ ID NO: 985 - protein, 10 aa, Artificial sequence
  Synthetic peptide
NGLVKKGKEQ

SEQ ID NO: 986 - protein, 10 aa, Artificial sequence
  Synthetic peptide
GLVKKGKEQN

SEQ ID NO: 987 - protein, 10 aa, Artificial sequence
  Synthetic peptide
LVKKGKEQNT

SEQ ID NO: 988 - protein, 10 aa, Artificial sequence
  Synthetic peptide
VKKGKEQNTQ

SEQ ID NO: 989 - protein, 10 aa, Artificial sequence
  Synthetic peptide
KKGKEQNTQR

SEQ ID NO: 990 - protein, 10 aa, Artificial sequence
  Synthetic peptide
KGKEQNTQRS

SEQ ID NO: 991 - protein, 10 aa, Artificial sequence
  Synthetic peptide
GKEQNTQRSF

SEQ ID NO: 992 - protein, 10 aa, Artificial sequence
  Synthetic peptide
KEQNTQRSFF

SEQ ID NO: 993 - protein, 10 aa, Artificial sequence
  Synthetic peptide
EQNTQRSFFL

SEQ ID NO: 994 - protein, 10 aa, Artificial sequence
  Synthetic peptide
QNTQRSFFLR

SEQ ID NO: 995 - protein, 10 aa, Artificial sequence
  Synthetic peptide
NTQRSFFLRM

SEQ ID NO: 996 - protein, 10 aa, Artificial sequence
  Synthetic peptide
TQRSFFLRMK

SEQ ID NO: 997 - protein, 10 aa, Artificial sequence
  Synthetic peptide
QRSFFLRMKC

SEQ ID NO: 998 - protein, 10 aa, Artificial sequence
  Synthetic peptide
RSFFLRMKCT

SEQ ID NO: 999 - protein, 10 aa, Artificial sequence
  Synthetic peptide
SFFLRMKCTL

SEQ ID NO: 1000 - protein, 10 aa, Artificial sequence
  Synthetic peptide
FFLRMKCTLT

SEQ ID NO: 1001 - protein, 10 aa, Artificial sequence
  Synthetic peptide
FLRMKCTLTS

SEQ ID NO: 1002 - protein, 10 aa, Artificial sequence
  Synthetic peptide
LRMKCTLTSR

SEQ ID NO: 1003 - protein, 10 aa, Artificial sequence
  Synthetic peptide
RMKCTLTSRG

SEQ ID NO: 1004 - protein, 10 aa, Artificial sequence
  Synthetic peptide
MKCTLTSRGR

SEQ ID NO: 1005 - protein, 10 aa, Artificial sequence
  Synthetic peptide
KCTLTSRGRT

SEQ ID NO: 1006 - protein, 10 aa, Artificial sequence
  Synthetic peptide
CTLTSRGRTM

SEQ ID NO: 1007 - protein, 10 aa, Artificial sequence
  Synthetic peptide
TLTSRGRTMN

SEQ ID NO: 1008 - protein, 10 aa, Artificial sequence
  Synthetic peptide
LTSRGRTMNI

SEQ ID NO: 1009 - protein, 10 aa, Artificial sequence
  Synthetic peptide
TSRGRTMNIK

SEQ ID NO: 1010 - protein, 10 aa, Artificial sequence
  Synthetic peptide
SRGRTMNIKS

SEQ ID NO: 1011 - protein, 10 aa, Artificial sequence
  Synthetic peptide
RGRTMNIKSA

SEQ ID NO: 1012 - protein, 10 aa, Artificial sequence
  Synthetic peptide
GRTMNIKSAT

SEQ ID NO: 1013 - protein, 10 aa, Artificial sequence
  Synthetic peptide
RTMNIKSATW

SEQ ID NO: 1014 - protein, 10 aa, Artificial sequence
  Synthetic peptide
TMNIKSATWK

SEQ ID NO: 1015 - protein, 10 aa, Artificial sequence
  Synthetic peptide
MNIKSATWKV

SEQ ID NO: 1016 - protein, 10 aa, Artificial sequence
  Synthetic peptide
NIKSATWKVL

SEQ ID NO: 1017 - protein, 10 aa, Artificial sequence
  Synthetic peptide
IKSATWKVLH

SEQ ID NO: 1018 - protein, 10 aa, Artificial sequence
  Synthetic peptide
KSATWKVLHC

SEQ ID NO: 1019 - protein, 10 aa, Artificial sequence
  Synthetic peptide
SATWKVLHCT

SEQ ID NO: 1020 - protein, 10 aa, Artificial sequence
  Synthetic peptide
ATWKVLHCTG

SEQ ID NO: 1021 - protein, 10 aa, Artificial sequence
  Synthetic peptide
TWKVLHCTGH

SEQ ID NO: 1022 - protein, 10 aa, Artificial sequence
  Synthetic peptide
WKVLHCTGHI

SEQ ID NO: 1023 - protein, 10 aa, Artificial sequence
  Synthetic peptide
KVLHCTGHIH

SEQ ID NO: 1024 - protein, 10 aa, Artificial sequence
  Synthetic peptide
VLHCTGHIHV

SEQ ID NO: 1025 - protein, 10 aa, Artificial sequence
  Synthetic peptide
LHCTGHIHVY

SEQ ID NO: 1026 - protein, 10 aa, Artificial sequence
  Synthetic peptide
HCTGHIHVYD

SEQ ID NO: 1027 - protein, 10 aa, Artificial sequence
  Synthetic peptide
CTGHIHVYDT

SEQ ID NO: 1028 - protein, 10 aa, Artificial sequence
  Synthetic peptide
TGHIHVYDTN

SEQ ID NO: 1029 - protein, 10 aa, Artificial sequence
  Synthetic peptide
GHIHVYDTNS

SEQ ID NO: 1030 - protein, 10 aa, Artificial sequence
  Synthetic peptide
HIHVYDTNSN

SEQ ID NO: 1031 - protein, 10 aa, Artificial sequence
  Synthetic peptide
IHVYDTNSNQ

SEQ ID NO: 1032 - protein, 10 aa, Artificial sequence
  Synthetic peptide
HVYDTNSNQP

SEQ ID NO: 1033 - protein, 10 aa, Artificial sequence
  Synthetic peptide
VYDTNSNQPQ

SEQ ID NO: 1034 - protein, 10 aa, Artificial sequence
  Synthetic peptide
YDTNSNQPQC

SEQ ID NO: 1035 - protein, 10 aa, Artificial sequence
  Synthetic peptide
DTNSNQPQCG

SEQ ID NO: 1036 - protein, 10 aa, Artificial sequence
  Synthetic peptide
TNSNQPQCGY

SEQ ID NO: 1037 - protein, 10 aa, Artificial sequence
  Synthetic peptide
NSNQPQCGYK

SEQ ID NO: 1038 - protein, 10 aa, Artificial sequence
  Synthetic peptide
SNQPQCGYKK

SEQ ID NO: 1039 - protein, 10 aa, Artificial sequence
  Synthetic peptide
NQPQCGYKKP

SEQ ID NO: 1040 - protein, 10 aa, Artificial sequence
  Synthetic peptide
QPQCGYKKPP

SEQ ID NO: 1041 - protein, 10 aa, Artificial sequence
  Synthetic peptide
PQCGYKKPPM

SEQ ID NO: 1042 - protein, 10 aa, Artificial sequence
  Synthetic peptide
QCGYKKPPMT

SEQ ID NO: 1043 - protein, 10 aa, Artificial sequence
  Synthetic peptide
CGYKKPPMTC

SEQ ID NO: 1044 - protein, 10 aa, Artificial sequence
  Synthetic peptide
GYKKPPMTCL

SEQ ID NO: 1045 - protein, 10 aa, Artificial sequence
  Synthetic peptide
YKKPPMTCLV

SEQ ID NO: 1046 - protein, 10 aa, Artificial sequence
  Synthetic peptide
KKPPMTCLVL

SEQ ID NO: 1047 - protein, 10 aa, Artificial sequence
  Synthetic peptide
KPPMTCLVLI

SEQ ID NO: 1048 - protein, 10 aa, Artificial sequence
  Synthetic peptide
PPMTCLVLIC

SEQ ID NO: 1049 - protein, 10 aa, Artificial sequence
  Synthetic peptide
PMTCLVLICE

SEQ ID NO: 1050 - protein, 10 aa, Artificial sequence
  Synthetic peptide
MTCLVLICEP

SEQ ID NO: 1051 - protein, 10 aa, Artificial sequence
  Synthetic peptide
TCLVLICEPI

SEQ ID NO: 1052 - protein, 10 aa, Artificial sequence
  Synthetic peptide
CLVLICEPIP

SEQ ID NO: 1053 - protein, 10 aa, Artificial sequence
  Synthetic peptide
LVLICEPIPH

SEQ ID NO: 1054 - protein, 10 aa, Artificial sequence
  Synthetic peptide
VLICEPIPHP

SEQ ID NO: 1055 - protein, 10 aa, Artificial sequence
  Synthetic peptide
LICEPIPHPS

SEQ ID NO: 1056 - protein, 10 aa, Artificial sequence
  Synthetic peptide
ICEPIPHPSN

SEQ ID NO: 1057 - protein, 10 aa, Artificial sequence
  Synthetic peptide
CEPIPHPSNI

SEQ ID NO: 1058 - protein, 10 aa, Artificial sequence
  Synthetic peptide
EPIPHPSNIE

SEQ ID NO: 1059 - protein, 10 aa, Artificial sequence
  Synthetic peptide
PIPHPSNIEI

SEQ ID NO: 1060 - protein, 10 aa, Artificial sequence
  Synthetic peptide
IPHPSNIEIP

SEQ ID NO: 1061 - protein, 10 aa, Artificial sequence
  Synthetic peptide
PHPSNIEIPL

SEQ ID NO: 1062 - protein, 10 aa, Artificial sequence
  Synthetic peptide
HPSNIEIPLD

SEQ ID NO: 1063 - protein, 10 aa, Artificial sequence
  Synthetic peptide
PSNIEIPLDS

SEQ ID NO: 1064 - protein, 10 aa, Artificial sequence
  Synthetic peptide
SNIEIPLDSK

SEQ ID NO: 1065 - protein, 10 aa, Artificial sequence
  Synthetic peptide
NIEIPLDSKT

SEQ ID NO: 1066 - protein, 10 aa, Artificial sequence
  Synthetic peptide
IEIPLDSKTF

SEQ ID NO: 1067 - protein, 10 aa, Artificial sequence
  Synthetic peptide
EIPLDSKTFL

SEQ ID NO: 1068 - protein, 10 aa, Artificial sequence
  Synthetic peptide
IPLDSKTFLS

SEQ ID NO: 1069 - protein, 10 aa, Artificial sequence
  Synthetic peptide
PLDSKTFLSR

SEQ ID NO: 1070 - protein, 10 aa, Artificial sequence
  Synthetic peptide
LDSKTFLSRH

SEQ ID NO: 1071 - protein, 10 aa, Artificial sequence
  Synthetic peptide
DSKTFLSRHS

SEQ ID NO: 1072 - protein, 10 aa, Artificial sequence
  Synthetic peptide
SKTFLSRHSL

SEQ ID NO: 1073 - protein, 10 aa, Artificial sequence
  Synthetic peptide
KTFLSRHSLD

SEQ ID NO: 1074 - protein, 10 aa, Artificial sequence
  Synthetic peptide
TFLSRHSLDM

SEQ ID NO: 1075 - protein, 10 aa, Artificial sequence
  Synthetic peptide
FLSRHSLDMK

SEQ ID NO: 1076 - protein, 10 aa, Artificial sequence
  Synthetic peptide
LSRHSLDMKF

SEQ ID NO: 1077 - protein, 10 aa, Artificial sequence
  Synthetic peptide
SRHSLDMKFS

SEQ ID NO: 1078 - protein, 10 aa, Artificial sequence
  Synthetic peptide
RHSLDMKFSY

SEQ ID NO: 1079 - protein, 10 aa, Artificial sequence
  Synthetic peptide
HSLDMKFSYC

SEQ ID NO: 1080 - protein, 10 aa, Artificial sequence
  Synthetic peptide
SLDMKFSYCD

SEQ ID NO: 1081 - protein, 10 aa, Artificial sequence
  Synthetic peptide
LDMKFSYCDE

SEQ ID NO: 1082 - protein, 10 aa, Artificial sequence
  Synthetic peptide
DMKFSYCDER

SEQ ID NO: 1083 - protein, 10 aa, Artificial sequence
  Synthetic peptide
MKFSYCDERI

SEQ ID NO: 1084 - protein, 10 aa, Artificial sequence
  Synthetic peptide
KFSYCDERIT

SEQ ID NO: 1085 - protein, 10 aa, Artificial sequence
  Synthetic peptide
FSYCDERITE

SEQ ID NO: 1086 - protein, 10 aa, Artificial sequence
  Synthetic peptide
SYCDERITEL

SEQ ID NO: 1087 - protein, 10 aa, Artificial sequence
  Synthetic peptide
YCDERITELM

SEQ ID NO: 1088 - protein, 10 aa, Artificial sequence
  Synthetic peptide
CDERITELMG

SEQ ID NO: 1089 - protein, 10 aa, Artificial sequence
  Synthetic peptide
DERITELMGY

SEQ ID NO: 1090 - protein, 10 aa, Artificial sequence
  Synthetic peptide
ERITELMGYE

SEQ ID NO: 1091 - protein, 10 aa, Artificial sequence
  Synthetic peptide
RITELMGYEP

SEQ ID NO: 1092 - protein, 10 aa, Artificial sequence
  Synthetic peptide
ITELMGYEPE

SEQ ID NO: 1093 - protein, 10 aa, Artificial sequence
  Synthetic peptide
TELMGYEPEE

SEQ ID NO: 1094 - protein, 10 aa, Artificial sequence
  Synthetic peptide
ELMGYEPEEL

SEQ ID NO: 1095 - protein, 10 aa, Artificial sequence
  Synthetic peptide
LMGYEPEELL

SEQ ID NO: 1096 - protein, 10 aa, Artificial sequence
  Synthetic peptide
MGYEPEELLG

SEQ ID NO: 1097 - protein, 10 aa, Artificial sequence
  Synthetic peptide
GYEPEELLGR

SEQ ID NO: 1098 - protein, 10 aa, Artificial sequence
  Synthetic peptide
YEPEELLGRS

SEQ ID NO: 1099 - protein, 10 aa, Artificial sequence
  Synthetic peptide
EPEELLGRSI

SEQ ID NO: 1100 - protein, 10 aa, Artificial sequence
  Synthetic peptide
PEELLGRSIY

SEQ ID NO: 1101 - protein, 10 aa, Artificial sequence
  Synthetic peptide
EELLGRSIYE

SEQ ID NO: 1102 - protein, 10 aa, Artificial sequence
  Synthetic peptide
ELLGRSIYEY

SEQ ID NO: 1103 - protein, 10 aa, Artificial sequence
  Synthetic peptide
LLGRSIYEYY

SEQ ID NO: 1104 - protein, 10 aa, Artificial sequence
  Synthetic peptide
LGRSIYEYYH

SEQ ID NO: 1105 - protein, 10 aa, Artificial sequence
  Synthetic peptide
GRSIYEYYHA

SEQ ID NO: 1106 - protein, 10 aa, Artificial sequence
  Synthetic peptide
RSIYEYYHAL

SEQ ID NO: 1107 - protein, 10 aa, Artificial sequence
  Synthetic peptide
SIYEYYHALD

SEQ ID NO: 1108 - protein, 10 aa, Artificial sequence
  Synthetic peptide
IYEYYHALDS

SEQ ID NO: 1109 - protein, 10 aa, Artificial sequence
  Synthetic peptide
YEYYHALDSD

SEQ ID NO: 1110 - protein, 10 aa, Artificial sequence
  Synthetic peptide
EYYHALDSDH

SEQ ID NO: 1111 - protein, 10 aa, Artificial sequence
  Synthetic peptide
YYHALDSDHL

SEQ ID NO: 1112 - protein, 10 aa, Artificial sequence
  Synthetic peptide
YHALDSDHLT

SEQ ID NO: 1113 - protein, 10 aa, Artificial sequence
  Synthetic peptide
HALDSDHLTK

SEQ ID NO: 1114 - protein, 10 aa, Artificial sequence
  Synthetic peptide
ALDSDHLTKT

SEQ ID NO: 1115 - protein, 10 aa, Artificial sequence
  Synthetic peptide
LDSDHLTKTH

SEQ ID NO: 1116 - protein, 10 aa, Artificial sequence
  Synthetic peptide
DSDHLTKTHH

SEQ ID NO: 1117 - protein, 10 aa, Artificial sequence
  Synthetic peptide
SDHLTKTHHD

SEQ ID NO: 1118 - protein, 10 aa, Artificial sequence
  Synthetic peptide
DHLTKTHHDM

SEQ ID NO: 1119 - protein, 10 aa, Artificial sequence
  Synthetic peptide
HLTKTHHDMF

SEQ ID NO: 1120 - protein, 10 aa, Artificial sequence
  Synthetic peptide
LTKTHHDMFT

SEQ ID NO: 1121 - protein, 10 aa, Artificial sequence
  Synthetic peptide
TKTHHDMFTK

SEQ ID NO: 1122 - protein, 10 aa, Artificial sequence
  Synthetic peptide
KTHHDMFTKG

SEQ ID NO: 1123 - protein, 10 aa, Artificial sequence
  Synthetic peptide
THHDMFTKGQ

SEQ ID NO: 1124 - protein, 10 aa, Artificial sequence
  Synthetic peptide
HHDMFTKGQV

SEQ ID NO: 1125 - protein, 10 aa, Artificial sequence
  Synthetic peptide
HDMFTKGQVT

SEQ ID NO: 1126 - protein, 10 aa, Artificial sequence
  Synthetic peptide
DMFTKGQVTT

SEQ ID NO: 1127 - protein, 10 aa, Artificial sequence
  Synthetic peptide
MFTKGQVTTG

SEQ ID NO: 1128 - protein, 10 aa, Artificial sequence
  Synthetic peptide
FTKGQVTTGQ

SEQ ID NO: 1129 - protein, 10 aa, Artificial sequence
  Synthetic peptide
TKGQVTTGQY

SEQ ID NO: 1130 - protein, 10 aa, Artificial sequence
  Synthetic peptide
KGQVTTGQYR

SEQ ID NO: 1131 - protein, 10 aa, Artificial sequence
  Synthetic peptide
GQVTTGQYRM

SEQ ID NO: 1132 - protein, 10 aa, Artificial sequence
  Synthetic peptide
QVTTGQYRML

SEQ ID NO: 1133 - protein, 10 aa, Artificial sequence
  Synthetic peptide
VTTGQYRMLA

SEQ ID NO: 1134 - protein, 10 aa, Artificial sequence
  Synthetic peptide
TTGQYRMLAK

SEQ ID NO: 1135 - protein, 10 aa, Artificial sequence
  Synthetic peptide
TGQYRMLAKR

SEQ ID NO: 1136 - protein, 10 aa, Artificial sequence
  Synthetic peptide
GQYRMLAKRG

SEQ ID NO: 1137 - protein, 10 aa, Artificial sequence
  Synthetic peptide
QYRMLAKRGG

SEQ ID NO: 1138 - protein, 10 aa, Artificial sequence
  Synthetic peptide
YRMLAKRGGY

SEQ ID NO: 1139 - protein, 10 aa, Artificial sequence
  Synthetic peptide
RMLAKRGGYV

SEQ ID NO: 1140 - protein, 10 aa, Artificial sequence
  Synthetic peptide
MLAKRGGYVW

SEQ ID NO: 1141 - protein, 10 aa, Artificial sequence
  Synthetic peptide
LAKRGGYVWV

SEQ ID NO: 1142 - protein, 10 aa, Artificial sequence
  Synthetic peptide
AKRGGYVWVE

SEQ ID NO: 1143 - protein, 10 aa, Artificial sequence
  Synthetic peptide
KRGGYVWVET

SEQ ID NO: 1144 - protein, 10 aa, Artificial sequence
  Synthetic peptide
RGGYVWVETQ

SEQ ID NO: 1145 - protein, 10 aa, Artificial sequence
  Synthetic peptide
GGYVWVETQA

SEQ ID NO: 1146 - protein, 10 aa, Artificial sequence
  Synthetic peptide
GYVWVETQAT

SEQ ID NO: 1147 - protein, 10 aa, Artificial sequence
  Synthetic peptide
YVWVETQATV

SEQ ID NO: 1148 - protein, 10 aa, Artificial sequence
  Synthetic peptide
VWVETQATVI

SEQ ID NO: 1149 - protein, 10 aa, Artificial sequence
  Synthetic peptide
WVETQATVIY

SEQ ID NO: 1150 - protein, 10 aa, Artificial sequence
  Synthetic peptide
VETQATVIYN

SEQ ID NO: 1151 - protein, 10 aa, Artificial sequence
  Synthetic peptide
ETQATVIYNT

SEQ ID NO: 1152 - protein, 10 aa, Artificial sequence
  Synthetic peptide
TQATVIYNTK

SEQ ID NO: 1153 - protein, 10 aa, Artificial sequence
  Synthetic peptide
QATVIYNTKN

SEQ ID NO: 1154 - protein, 10 aa, Artificial sequence
  Synthetic peptide
ATVIYNTKNS

SEQ ID NO: 1155 - protein, 10 aa, Artificial sequence
  Synthetic peptide
TVIYNTKNSQ

SEQ ID NO: 1156 - protein, 10 aa, Artificial sequence
  Synthetic peptide
VIYNTKNSQP

SEQ ID NO: 1157 - protein, 10 aa, Artificial sequence
  Synthetic peptide
IYNTKNSQPQ

SEQ ID NO: 1158 - protein, 10 aa, Artificial sequence
  Synthetic peptide
YNTKNSQPQC

SEQ ID NO: 1159 - protein, 10 aa, Artificial sequence
  Synthetic peptide
NTKNSQPQCI

SEQ ID NO: 1160 - protein, 10 aa, Artificial sequence
  Synthetic peptide
TKNSQPQCIV

SEQ ID NO: 1161 - protein, 10 aa, Artificial sequence
  Synthetic peptide
KNSQPQCIVC

SEQ ID NO: 1162 - protein, 10 aa, Artificial sequence
  Synthetic peptide
NSQPQCIVCV

SEQ ID NO: 1163 - protein, 10 aa, Artificial sequence
  Synthetic peptide
SQPQCIVCVN

SEQ ID NO: 1164 - protein, 10 aa, Artificial sequence
  Synthetic peptide
QPQCIVCVNY

SEQ ID NO: 1165 - protein, 10 aa, Artificial sequence
  Synthetic peptide
PQCIVCVNYV

SEQ ID NO: 1166 - protein, 10 aa, Artificial sequence
  Synthetic peptide
QCIVCVNYVV

SEQ ID NO: 1167 - protein, 10 aa, Artificial sequence
  Synthetic peptide
CIVCVNYVVS

SEQ ID NO: 1168 - protein, 10 aa, Artificial sequence
  Synthetic peptide
IVCVNYVVSG

SEQ ID NO: 1169 - protein, 10 aa, Artificial sequence
  Synthetic peptide
VCVNYVVSGI

SEQ ID NO: 1170 - protein, 10 aa, Artificial sequence
  Synthetic peptide
CVNYVVSGII

SEQ ID NO: 1171 - protein, 10 aa, Artificial sequence
  Synthetic peptide
VNYVVSGIIQ

SEQ ID NO: 1172 - protein, 10 aa, Artificial sequence
  Synthetic peptide
NYVVSGIIQH

SEQ ID NO: 1173 - protein, 10 aa, Artificial sequence
  Synthetic peptide
YVVSGIIQHD

SEQ ID NO: 1174 - protein, 10 aa, Artificial sequence
  Synthetic peptide
VVSGIIQHDL

SEQ ID NO: 1175 - protein, 10 aa, Artificial sequence
  Synthetic peptide
VSGIIQHDLI

SEQ ID NO: 1176 - protein, 10 aa, Artificial sequence
  Synthetic peptide
SGIIQHDLIF

SEQ ID NO: 1177 - protein, 10 aa, Artificial sequence
  Synthetic peptide
GIIQHDLIFS

SEQ ID NO: 1178 - protein, 10 aa, Artificial sequence
  Synthetic peptide
IIQHDLIFSL

SEQ ID NO: 1179 - protein, 10 aa, Artificial sequence
  Synthetic peptide
IQHDLIFSLQ

SEQ ID NO: 1180 - protein, 10 aa, Artificial sequence
  Synthetic peptide
QHDLIFSLQQ

SEQ ID NO: 1181 - protein, 10 aa, Artificial sequence
  Synthetic peptide
HDLIFSLQQT

SEQ ID NO: 1182 - protein, 10 aa, Artificial sequence
  Synthetic peptide
DLIFSLQQTE

SEQ ID NO: 1183 - protein, 10 aa, Artificial sequence
  Synthetic peptide
LIFSLQQTEC

SEQ ID NO: 1184 - protein, 10 aa, Artificial sequence
  Synthetic peptide
IFSLQQTECV

SEQ ID NO: 1185 - protein, 10 aa, Artificial sequence
  Synthetic peptide
FSLQQTECVL

SEQ ID NO: 1186 - protein, 10 aa, Artificial sequence
  Synthetic peptide
SLQQTECVLK

SEQ ID NO: 1187 - protein, 10 aa, Artificial sequence
  Synthetic peptide
LQQTECVLKP

SEQ ID NO: 1188 - protein, 10 aa, Artificial sequence
  Synthetic peptide
QQTECVLKPV

SEQ ID NO: 1189 - protein, 10 aa, Artificial sequence
  Synthetic peptide
QTECVLKPVE

SEQ ID NO: 1190 - protein, 10 aa, Artificial sequence
  Synthetic peptide
TECVLKPVES

SEQ ID NO: 1191 - protein, 10 aa, Artificial sequence
  Synthetic peptide
ECVLKPVESS

SEQ ID NO: 1192 - protein, 10 aa, Artificial sequence
  Synthetic peptide
CVLKPVESSD

SEQ ID NO: 1193 - protein, 10 aa, Artificial sequence
  Synthetic peptide
VLKPVESSDM

SEQ ID NO: 1194 - protein, 10 aa, Artificial sequence
  Synthetic peptide
LKPVESSDMK

SEQ ID NO: 1195 - protein, 10 aa, Artificial sequence
  Synthetic peptide
KPVESSDMKM

SEQ ID NO: 1196 - protein, 10 aa, Artificial sequence
  Synthetic peptide
PVESSDMKMT

SEQ ID NO: 1197 - protein, 10 aa, Artificial sequence
  Synthetic peptide
VESSDMKMTQ

SEQ ID NO: 1198 - protein, 10 aa, Artificial sequence
  Synthetic peptide
ESSDMKMTQL

SEQ ID NO: 1199 - protein, 10 aa, Artificial sequence
  Synthetic peptide
SSDMKMTQLF

SEQ ID NO: 1200 - protein, 10 aa, Artificial sequence
  Synthetic peptide
SDMKMTQLFT

SEQ ID NO: 1201 - protein, 10 aa, Artificial sequence
  Synthetic peptide
DMKMTQLFTK

SEQ ID NO: 1202 - protein, 10 aa, Artificial sequence
  Synthetic peptide
MKMTQLFTKV

SEQ ID NO: 1203 - protein, 10 aa, Artificial sequence
  Synthetic peptide
KMTQLFTKVE

SEQ ID NO: 1204 - protein, 10 aa, Artificial sequence
  Synthetic peptide
MTQLFTKVES

SEQ ID NO: 1205 - protein, 10 aa, Artificial sequence
  Synthetic peptide
TQLFTKVESE

SEQ ID NO: 1206 - protein, 10 aa, Artificial sequence
  Synthetic peptide
QLFTKVESED

SEQ ID NO: 1207 - protein, 10 aa, Artificial sequence
  Synthetic peptide
LFTKVESEDT

SEQ ID NO: 1208 - protein, 10 aa, Artificial sequence
  Synthetic peptide
FTKVESEDTS

SEQ ID NO: 1209 - protein, 10 aa, Artificial sequence
  Synthetic peptide
TKVESEDTSS

SEQ ID NO: 1210 - protein, 10 aa, Artificial sequence
  Synthetic peptide
KVESEDTSSL

SEQ ID NO: 1211 - protein, 10 aa, Artificial sequence
  Synthetic peptide
VESEDTSSLF

SEQ ID NO: 1212 - protein, 10 aa, Artificial sequence
  Synthetic peptide
ESEDTSSLFD

SEQ ID NO: 1213 - protein, 10 aa, Artificial sequence
  Synthetic peptide
SEDTSSLFDK

SEQ ID NO: 1214 - protein, 10 aa, Artificial sequence
  Synthetic peptide
EDTSSLFDKL

SEQ ID NO: 1215 - protein, 10 aa, Artificial sequence
  Synthetic peptide
DTSSLFDKLK

SEQ ID NO: 1216 - protein, 10 aa, Artificial sequence
  Synthetic peptide
TSSLFDKLKK

SEQ ID NO: 1217 - protein, 10 aa, Artificial sequence
  Synthetic peptide
SSLFDKLKKE

SEQ ID NO: 1218 - protein, 10 aa, Artificial sequence
  Synthetic peptide
SLFDKLKKEP

SEQ ID NO: 1219 - protein, 10 aa, Artificial sequence
  Synthetic peptide
LFDKLKKEPD

SEQ ID NO: 1220 - protein, 10 aa, Artificial sequence
  Synthetic peptide
FDKLKKEPDA

SEQ ID NO: 1221 - protein, 10 aa, Artificial sequence
  Synthetic peptide
DKLKKEPDAL

SEQ ID NO: 1222 - protein, 10 aa, Artificial sequence
  Synthetic peptide
KLKKEPDALT

SEQ ID NO: 1223 - protein, 10 aa, Artificial sequence
  Synthetic peptide
LKKEPDALTL

SEQ ID NO: 1224 - protein, 10 aa, Artificial sequence
  Synthetic peptide
KKEPDALTLL

SEQ ID NO: 1225 - protein, 10 aa, Artificial sequence
  Synthetic peptide
KEPDALTLLA

SEQ ID NO: 1226 - protein, 10 aa, Artificial sequence
  Synthetic peptide
EPDALTLLAP

SEQ ID NO: 1227 - protein, 10 aa, Artificial sequence
  Synthetic peptide
PDALTLLAPA

SEQ ID NO: 1228 - protein, 10 aa, Artificial sequence
  Synthetic peptide
DALTLLAPAA

SEQ ID NO: 1229 - protein, 10 aa, Artificial sequence
  Synthetic peptide
ALTLLAPAAG

SEQ ID NO: 1230 - protein, 10 aa, Artificial sequence
  Synthetic peptide
LTLLAPAAGD

SEQ ID NO: 1231 - protein, 10 aa, Artificial sequence
  Synthetic peptide
TLLAPAAGDT

SEQ ID NO: 1232 - protein, 10 aa, Artificial sequence
  Synthetic peptide
LLAPAAGDTI

SEQ ID NO: 1233 - protein, 10 aa, Artificial sequence
  Synthetic peptide
LAPAAGDTII

SEQ ID NO: 1234 - protein, 10 aa, Artificial sequence
  Synthetic peptide
APAAGDTIIS

SEQ ID NO: 1235 - protein, 10 aa, Artificial sequence
  Synthetic peptide
PAAGDTIISL

SEQ ID NO: 1236 - protein, 10 aa, Artificial sequence
  Synthetic peptide
AAGDTIISLD

SEQ ID NO: 1237 - protein, 10 aa, Artificial sequence
  Synthetic peptide
AGDTIISLDF

SEQ ID NO: 1238 - protein, 10 aa, Artificial sequence
  Synthetic peptide
GDTIISLDFG

SEQ ID NO: 1239 - protein, 10 aa, Artificial sequence
  Synthetic peptide
DTIISLDFGS

SEQ ID NO: 1240 - protein, 10 aa, Artificial sequence
  Synthetic peptide
TIISLDFGSN

SEQ ID NO: 1241 - protein, 10 aa, Artificial sequence
  Synthetic peptide
IISLDFGSND

SEQ ID NO: 1242 - protein, 10 aa, Artificial sequence
  Synthetic peptide
ISLDFGSNDT

SEQ ID NO: 1243 - protein, 10 aa, Artificial sequence
  Synthetic peptide
SLDFGSNDTE

SEQ ID NO: 1244 - protein, 10 aa, Artificial sequence
  Synthetic peptide
LDFGSNDTET

SEQ ID NO: 1245 - protein, 10 aa, Artificial sequence
  Synthetic peptide
DFGSNDTETD

SEQ ID NO: 1246 - protein, 10 aa, Artificial sequence
  Synthetic peptide
FGSNDTETDD

SEQ ID NO: 1247 - protein, 10 aa, Artificial sequence
  Synthetic peptide
GSNDTETDDQ

SEQ ID NO: 1248 - protein, 10 aa, Artificial sequence
  Synthetic peptide
SNDTETDDQQ

SEQ ID NO: 1249 - protein, 10 aa, Artificial sequence
  Synthetic peptide
NDTETDDQQL

SEQ ID NO: 1250 - protein, 10 aa, Artificial sequence
  Synthetic peptide
DTETDDQQLE

SEQ ID NO: 1251 - protein, 10 aa, Artificial sequence
  Synthetic peptide
TETDDQQLEE

SEQ ID NO: 1252 - protein, 10 aa, Artificial sequence
  Synthetic peptide
ETDDQQLEEV

SEQ ID NO: 1253 - protein, 10 aa, Artificial sequence
  Synthetic peptide
TDDQQLEEVP

SEQ ID NO: 1254 - protein, 10 aa, Artificial sequence
  Synthetic peptide
DDQQLEEVPL

SEQ ID NO: 1255 - protein, 10 aa, Artificial sequence
  Synthetic peptide
DQQLEEVPLY

SEQ ID NO: 1256 - protein, 10 aa, Artificial sequence
  Synthetic peptide
QQLEEVPLYN

SEQ ID NO: 1257 - protein, 10 aa, Artificial sequence
  Synthetic peptide
QLEEVPLYND

SEQ ID NO: 1258 - protein, 10 aa, Artificial sequence
  Synthetic peptide
LEEVPLYNDV

SEQ ID NO: 1259 - protein, 10 aa, Artificial sequence
  Synthetic peptide
EEVPLYNDVM

SEQ ID NO: 1260 - protein, 10 aa, Artificial sequence
  Synthetic peptide
EVPLYNDVML

SEQ ID NO: 1261 - protein, 10 aa, Artificial sequence
  Synthetic peptide
VPLYNDVMLP

SEQ ID NO: 1262 - protein, 10 aa, Artificial sequence
  Synthetic peptide
PLYNDVMLPS

SEQ ID NO: 1263 - protein, 10 aa, Artificial sequence
  Synthetic peptide
LYNDVMLPSP

SEQ ID NO: 1264 - protein, 10 aa, Artificial sequence
  Synthetic peptide
YNDVMLPSPN

SEQ ID NO: 1265 - protein, 10 aa, Artificial sequence
  Synthetic peptide
NDVMLPSPNE

SEQ ID NO: 1266 - protein, 10 aa, Artificial sequence
  Synthetic peptide
DVMLPSPNEK

SEQ ID NO: 1267 - protein, 10 aa, Artificial sequence
  Synthetic peptide
VMLPSPNEKL

SEQ ID NO: 1268 - protein, 10 aa, Artificial sequence
  Synthetic peptide
MLPSPNEKLQ

SEQ ID NO: 1269 - protein, 10 aa, Artificial sequence
  Synthetic peptide
LPSPNEKLQN

SEQ ID NO: 1270 - protein, 10 aa, Artificial sequence
  Synthetic peptide
PSPNEKLQNI

SEQ ID NO: 1271 - protein, 10 aa, Artificial sequence
  Synthetic peptide
SPNEKLQNIN

SEQ ID NO: 1272 - protein, 10 aa, Artificial sequence
  Synthetic peptide
PNEKLQNINL

SEQ ID NO: 1273 - protein, 10 aa, Artificial sequence
  Synthetic peptide
NEKLQNINLA

SEQ ID NO: 1274 - protein, 10 aa, Artificial sequence
  Synthetic peptide
EKLQNINLAM

SEQ ID NO: 1275 - protein, 10 aa, Artificial sequence
  Synthetic peptide
KLQNINLAMS

SEQ ID NO: 1276 - protein, 10 aa, Artificial sequence
  Synthetic peptide
LQNINLAMSP

SEQ ID NO: 1277 - protein, 10 aa, Artificial sequence
  Synthetic peptide
QNINLAMSPL

SEQ ID NO: 1278 - protein, 10 aa, Artificial sequence
  Synthetic peptide
NINLAMSPLP

SEQ ID NO: 1279 - protein, 10 aa, Artificial sequence
  Synthetic peptide
INLAMSPLPT

SEQ ID NO: 1280 - protein, 10 aa, Artificial sequence
  Synthetic peptide
NLAMSPLPTA

SEQ ID NO: 1281 - protein, 10 aa, Artificial sequence
  Synthetic peptide
LAMSPLPTAE

SEQ ID NO: 1282 - protein, 10 aa, Artificial sequence
  Synthetic peptide
AMSPLPTAET

SEQ ID NO: 1283 - protein, 10 aa, Artificial sequence
  Synthetic peptide
MSPLPTAETP

SEQ ID NO: 1284 - protein, 10 aa, Artificial sequence
  Synthetic peptide
SPLPTAETPK

SEQ ID NO: 1285 - protein, 10 aa, Artificial sequence
  Synthetic peptide
PLPTAETPKP

SEQ ID NO: 1286 - protein, 10 aa, Artificial sequence
  Synthetic peptide
LPTAETPKPL

SEQ ID NO: 1287 - protein, 10 aa, Artificial sequence
  Synthetic peptide
PTAETPKPLR

SEQ ID NO: 1288 - protein, 10 aa, Artificial sequence
  Synthetic peptide
TAETPKPLRS

SEQ ID NO: 1289 - protein, 10 aa, Artificial sequence
  Synthetic peptide
AETPKPLRSS

SEQ ID NO: 1290 - protein, 10 aa, Artificial sequence
  Synthetic peptide
ETPKPLRSSA

SEQ ID NO: 1291 - protein, 10 aa, Artificial sequence
  Synthetic peptide
TPKPLRSSAD

SEQ ID NO: 1292 - protein, 10 aa, Artificial sequence
  Synthetic peptide
PKPLRSSADP

SEQ ID NO: 1293 - protein, 10 aa, Artificial sequence
  Synthetic peptide
KPLRSSADPA

SEQ ID NO: 1294 - protein, 10 aa, Artificial sequence
  Synthetic peptide
PLRSSADPAL

SEQ ID NO: 1295 - protein, 10 aa, Artificial sequence
  Synthetic peptide
LRSSADPALN

SEQ ID NO: 1296 - protein, 10 aa, Artificial sequence
  Synthetic peptide
RSSADPALNQ

SEQ ID NO: 1297 - protein, 10 aa, Artificial sequence
  Synthetic peptide
SSADPALNQE

SEQ ID NO: 1298 - protein, 10 aa, Artificial sequence
  Synthetic peptide
SADPALNQEV

SEQ ID NO: 1299 - protein, 10 aa, Artificial sequence
  Synthetic peptide
ADPALNQEVA

SEQ ID NO: 1300 - protein, 10 aa, Artificial sequence
  Synthetic peptide
DPALNQEVAL

SEQ ID NO: 1301 - protein, 10 aa, Artificial sequence
  Synthetic peptide
PALNQEVALK

SEQ ID NO: 1302 - protein, 10 aa, Artificial sequence
  Synthetic peptide
ALNQEVALKL

SEQ ID NO: 1303 - protein, 10 aa, Artificial sequence
  Synthetic peptide
LNQEVALKLE

SEQ ID NO: 1304 - protein, 10 aa, Artificial sequence
  Synthetic peptide
NQEVALKLEP

SEQ ID NO: 1305 - protein, 10 aa, Artificial sequence
  Synthetic peptide
QEVALKLEPN

SEQ ID NO: 1306 - protein, 10 aa, Artificial sequence
  Synthetic peptide
EVALKLEPNP

SEQ ID NO: 1307 - protein, 10 aa, Artificial sequence
  Synthetic peptide
VALKLEPNPE

SEQ ID NO: 1308 - protein, 10 aa, Artificial sequence
  Synthetic peptide
ALKLEPNPES

SEQ ID NO: 1309 - protein, 10 aa, Artificial sequence
  Synthetic peptide
LKLEPNPESL

SEQ ID NO: 1310 - protein, 10 aa, Artificial sequence
  Synthetic peptide
KLEPNPESLE

SEQ ID NO: 1311 - protein, 10 aa, Artificial sequence
  Synthetic peptide
LEPNPESLEL

SEQ ID NO: 1312 - protein, 10 aa, Artificial sequence
  Synthetic peptide
EPNPESLELS

SEQ ID NO: 1313 - protein, 10 aa, Artificial sequence
  Synthetic peptide
PNPESLELSF

SEQ ID NO: 1314 - protein, 10 aa, Artificial sequence
  Synthetic peptide
NPESLELSFT

SEQ ID NO: 1315 - protein, 10 aa, Artificial sequence
  Synthetic peptide
PESLELSFTM

SEQ ID NO: 1316 - protein, 10 aa, Artificial sequence
  Synthetic peptide
ESLELSFTMP

SEQ ID NO: 1317 - protein, 10 aa, Artificial sequence
  Synthetic peptide
SLELSFTMPQ

SEQ ID NO: 1318 - protein, 10 aa, Artificial sequence
  Synthetic peptide
LELSFTMPQI

SEQ ID NO: 1319 - protein, 10 aa, Artificial sequence
  Synthetic peptide
ELSFTMPQIQ

SEQ ID NO: 1320 - protein, 10 aa, Artificial sequence
  Synthetic peptide
LSFTMPQIQD

SEQ ID NO: 1321 - protein, 10 aa, Artificial sequence
  Synthetic peptide
SFTMPQIQDQ

SEQ ID NO: 1322 - protein, 10 aa, Artificial sequence
  Synthetic peptide
FTMPQIQDQT

SEQ ID NO: 1323 - protein, 10 aa, Artificial sequence
  Synthetic peptide
TMPQIQDQTP

SEQ ID NO: 1324 - protein, 10 aa, Artificial sequence
  Synthetic peptide
MPQIQDQTPS

SEQ ID NO: 1325 - protein, 10 aa, Artificial sequence
  Synthetic peptide
PQIQDQTPSP

SEQ ID NO: 1326 - protein, 10 aa, Artificial sequence
  Synthetic peptide
QIQDQTPSPS

SEQ ID NO: 1327 - protein, 10 aa, Artificial sequence
  Synthetic peptide
IQDQTPSPSD

SEQ ID NO: 1328 - protein, 10 aa, Artificial sequence
  Synthetic peptide
QDQTPSPSDG

SEQ ID NO: 1329 - protein, 10 aa, Artificial sequence
  Synthetic peptide
DQTPSPSDGS

SEQ ID NO: 1330 - protein, 10 aa, Artificial sequence
  Synthetic peptide
QTPSPSDGST

SEQ ID NO: 1331 - protein, 10 aa, Artificial sequence
  Synthetic peptide
TPSPSDGSTR

SEQ ID NO: 1332 - protein, 10 aa, Artificial sequence
  Synthetic peptide
PSPSDGSTRQ

SEQ ID NO: 1333 - protein, 10 aa, Artificial sequence
  Synthetic peptide
SPSDGSTRQS

SEQ ID NO: 1334 - protein, 10 aa, Artificial sequence
  Synthetic peptide
PSDGSTRQSS

SEQ ID NO: 1335 - protein, 10 aa, Artificial sequence
  Synthetic peptide
SDGSTRQSSP

SEQ ID NO: 1336 - protein, 10 aa, Artificial sequence
  Synthetic peptide
DGSTRQSSPE

SEQ ID NO: 1337 - protein, 10 aa, Artificial sequence
  Synthetic peptide
GSTRQSSPEP

SEQ ID NO: 1338 - protein, 10 aa, Artificial sequence
  Synthetic peptide
STRQSSPEPN

SEQ ID NO: 1339 - protein, 10 aa, Artificial sequence
  Synthetic peptide
TRQSSPEPNS

SEQ ID NO: 1340 - protein, 10 aa, Artificial sequence
  Synthetic peptide
RQSSPEPNSP

SEQ ID NO: 1341 - protein, 10 aa, Artificial sequence
  Synthetic peptide
QSSPEPNSPS

SEQ ID NO: 1342 - protein, 10 aa, Artificial sequence
  Synthetic peptide
SSPEPNSPSE

SEQ ID NO: 1343 - protein, 10 aa, Artificial sequence
  Synthetic peptide
SPEPNSPSEY

SEQ ID NO: 1344 - protein, 10 aa, Artificial sequence
  Synthetic peptide
PEPNSPSEYC

SEQ ID NO: 1345 - protein, 10 aa, Artificial sequence
  Synthetic peptide
EPNSPSEYCF

SEQ ID NO: 1346 - protein, 10 aa, Artificial sequence
  Synthetic peptide
PNSPSEYCFY

SEQ ID NO: 1347 - protein, 10 aa, Artificial sequence
  Synthetic peptide
NSPSEYCFYV

SEQ ID NO: 1348 - protein, 10 aa, Artificial sequence
  Synthetic peptide
SPSEYCFYVD

SEQ ID NO: 1349 - protein, 10 aa, Artificial sequence
  Synthetic peptide
PSEYCFYVDS

SEQ ID NO: 1350 - protein, 10 aa, Artificial sequence
  Synthetic peptide
SEYCFYVDSD

SEQ ID NO: 1351 - protein, 10 aa, Artificial sequence
  Synthetic peptide
EYCFYVDSDM

SEQ ID NO: 1352 - protein, 10 aa, Artificial sequence
  Synthetic peptide
YCFYVDSDMV

SEQ ID NO: 1353 - protein, 10 aa, Artificial sequence
  Synthetic peptide
CFYVDSDMVN

SEQ ID NO: 1354 - protein, 10 aa, Artificial sequence
  Synthetic peptide
FYVDSDMVNE

SEQ ID NO: 1355 - protein, 10 aa, Artificial sequence
  Synthetic peptide
YVDSDMVNEF

SEQ ID NO: 1356 - protein, 10 aa, Artificial sequence
  Synthetic peptide
VDSDMVNEFK

SEQ ID NO: 1357 - protein, 10 aa, Artificial sequence
  Synthetic peptide
DSDMVNEFKL

SEQ ID NO: 1358 - protein, 10 aa, Artificial sequence
  Synthetic peptide
SDMVNEFKLE

SEQ ID NO: 1359 - protein, 10 aa, Artificial sequence
  Synthetic peptide
DMVNEFKLEL

SEQ ID NO: 1360 - protein, 10 aa, Artificial sequence
  Synthetic peptide
MVNEFKLELV

SEQ ID NO: 1361 - protein, 10 aa, Artificial sequence
  Synthetic peptide
VNEFKLELVE

SEQ ID NO: 1362 - protein, 10 aa, Artificial sequence
  Synthetic peptide
NEFKLELVEK

SEQ ID NO: 1363 - protein, 10 aa, Artificial sequence
  Synthetic peptide
EFKLELVEKL

SEQ ID NO: 1364 - protein, 10 aa, Artificial sequence
  Synthetic peptide
FKLELVEKLF

SEQ ID NO: 1365 - protein, 10 aa, Artificial sequence
  Synthetic peptide
KLELVEKLFA

SEQ ID NO: 1366 - protein, 10 aa, Artificial sequence
  Synthetic peptide
LELVEKLFAE

SEQ ID NO: 1367 - protein, 10 aa, Artificial sequence
  Synthetic peptide
ELVEKLFAED

SEQ ID NO: 1368 - protein, 10 aa, Artificial sequence
  Synthetic peptide
LVEKLFAEDT

SEQ ID NO: 1369 - protein, 10 aa, Artificial sequence
  Synthetic peptide
VEKLFAEDTE

SEQ ID NO: 1370 - protein, 10 aa, Artificial sequence
  Synthetic peptide
EKLFAEDTEA

SEQ ID NO: 1371 - protein, 10 aa, Artificial sequence
  Synthetic peptide
KLFAEDTEAK

SEQ ID NO: 1372 - protein, 10 aa, Artificial sequence
  Synthetic peptide
LFAEDTEAKN

SEQ ID NO: 1373 - protein, 10 aa, Artificial sequence
  Synthetic peptide
FAEDTEAKNP

SEQ ID NO: 1374 - protein, 10 aa, Artificial sequence
  Synthetic peptide
AEDTEAKNPF

SEQ ID NO: 1375 - protein, 10 aa, Artificial sequence
  Synthetic peptide
EDTEAKNPFS

SEQ ID NO: 1376 - protein, 10 aa, Artificial sequence
  Synthetic peptide
DTEAKNPFST

SEQ ID NO: 1377 - protein, 10 aa, Artificial sequence
  Synthetic peptide
TEAKNPFSTQ

SEQ ID NO: 1378 - protein, 10 aa, Artificial sequence
  Synthetic peptide
EAKNPFSTQD

SEQ ID NO: 1379 - protein, 10 aa, Artificial sequence
  Synthetic peptide
AKNPFSTQDT

SEQ ID NO: 1380 - protein, 10 aa, Artificial sequence
  Synthetic peptide
KNPFSTQDTD

SEQ ID NO: 1381 - protein, 10 aa, Artificial sequence
  Synthetic peptide
NPFSTQDTDL

SEQ ID NO: 1382 - protein, 10 aa, Artificial sequence
  Synthetic peptide
PFSTQDTDLD

SEQ ID NO: 1383 - protein, 10 aa, Artificial sequence
  Synthetic peptide
FSTQDTDLDL

SEQ ID NO: 1384 - protein, 10 aa, Artificial sequence
  Synthetic peptide
STQDTDLDLE

SEQ ID NO: 1385 - protein, 10 aa, Artificial sequence
  Synthetic peptide
TQDTDLDLEM

SEQ ID NO: 1386 - protein, 10 aa, Artificial sequence
  Synthetic peptide
QDTDLDLEML

SEQ ID NO: 1387 - protein, 10 aa, Artificial sequence
  Synthetic peptide
DTDLDLEMLA

SEQ ID NO: 1388 - protein, 10 aa, Artificial sequence
  Synthetic peptide
TDLDLEMLAP

SEQ ID NO: 1389 - protein, 10 aa, Artificial sequence
  Synthetic peptide
DLDLEMLAPY

SEQ ID NO: 1390 - protein, 10 aa, Artificial sequence
  Synthetic peptide
LDLEMLAPYI

SEQ ID NO: 1391 - protein, 10 aa, Artificial sequence
  Synthetic peptide
DLEMLAPYIP

SEQ ID NO: 1392 - protein, 10 aa, Artificial sequence
  Synthetic peptide
LEMLAPYIPM

SEQ ID NO: 1393 - protein, 10 aa, Artificial sequence
  Synthetic peptide
EMLAPYIPMD

SEQ ID NO: 1394 - protein, 10 aa, Artificial sequence
  Synthetic peptide
MLAPYIPMDD

SEQ ID NO: 1395 - protein, 10 aa, Artificial sequence
  Synthetic peptide
LAPYIPMDDD

SEQ ID NO: 1396 - protein, 10 aa, Artificial sequence
  Synthetic peptide
APYIPMDDDF

SEQ ID NO: 1397 - protein, 10 aa, Artificial sequence
  Synthetic peptide
PYIPMDDDFQ

SEQ ID NO: 1398 - protein, 10 aa, Artificial sequence
  Synthetic peptide
YIPMDDDFQL

SEQ ID NO: 1399 - protein, 10 aa, Artificial sequence
  Synthetic peptide
IPMDDDFQLR

SEQ ID NO: 1400 - protein, 10 aa, Artificial sequence
  Synthetic peptide
PMDDDFQLRS

SEQ ID NO: 1401 - protein, 10 aa, Artificial sequence
  Synthetic peptide
MDDDFQLRSF

SEQ ID NO: 1402 - protein, 10 aa, Artificial sequence
  Synthetic peptide
DDDFQLRSFD

SEQ ID NO: 1403 - protein, 10 aa, Artificial sequence
  Synthetic peptide
DDFQLRSFDQ

SEQ ID NO: 1404 - protein, 10 aa, Artificial sequence
  Synthetic peptide
DFQLRSFDQL

SEQ ID NO: 1405 - protein, 10 aa, Artificial sequence
  Synthetic peptide
FQLRSFDQLS

SEQ ID NO: 1406 - protein, 10 aa, Artificial sequence
  Synthetic peptide
QLRSFDQLSP

SEQ ID NO: 1407 - protein, 10 aa, Artificial sequence
  Synthetic peptide
LRSFDQLSPL

SEQ ID NO: 1408 - protein, 10 aa, Artificial sequence
  Synthetic peptide
RSFDQLSPLE

SEQ ID NO: 1409 - protein, 10 aa, Artificial sequence
  Synthetic peptide
SFDQLSPLES

SEQ ID NO: 1410 - protein, 10 aa, Artificial sequence
  Synthetic peptide
FDQLSPLESS

SEQ ID NO: 1411 - protein, 10 aa, Artificial sequence
  Synthetic peptide
DQLSPLESSS

SEQ ID NO: 1412 - protein, 10 aa, Artificial sequence
  Synthetic peptide
QLSPLESSSA

SEQ ID NO: 1413 - protein, 10 aa, Artificial sequence
  Synthetic peptide
LSPLESSSAS

SEQ ID NO: 1414 - protein, 10 aa, Artificial sequence
  Synthetic peptide
SPLESSSASP

SEQ ID NO: 1415 - protein, 10 aa, Artificial sequence
  Synthetic peptide
PLESSSASPE

SEQ ID NO: 1416 - protein, 10 aa, Artificial sequence
  Synthetic peptide
LESSSASPES

SEQ ID NO: 1417 - protein, 10 aa, Artificial sequence
  Synthetic peptide
ESSSASPESA

SEQ ID NO: 1418 - protein, 10 aa, Artificial sequence
  Synthetic peptide
SSSASPESAS

SEQ ID NO: 1419 - protein, 10 aa, Artificial sequence
  Synthetic peptide
SSASPESASP

SEQ ID NO: 1420 - protein, 10 aa, Artificial sequence
  Synthetic peptide
SASPESASPQ

SEQ ID NO: 1421 - protein, 10 aa, Artificial sequence
  Synthetic peptide
ASPESASPQS

SEQ ID NO: 1422 - protein, 10 aa, Artificial sequence
  Synthetic peptide
SPESASPQST

SEQ ID NO: 1423 - protein, 10 aa, Artificial sequence
  Synthetic peptide
PESASPQSTV

SEQ ID NO: 1424 - protein, 10 aa, Artificial sequence
  Synthetic peptide
ESASPQSTVT

SEQ ID NO: 1425 - protein, 10 aa, Artificial sequence
  Synthetic peptide
SASPQSTVTV

SEQ ID NO: 1426 - protein, 10 aa, Artificial sequence
  Synthetic peptide
ASPQSTVTVF

SEQ ID NO: 1427 - protein, 10 aa, Artificial sequence
  Synthetic peptide
SPQSTVTVFQ

SEQ ID NO: 1428 - protein, 10 aa, Artificial sequence
  Synthetic peptide
PQSTVTVFQQ

SEQ ID NO: 1429 - protein, 10 aa, Artificial sequence
  Synthetic peptide
QSTVTVFQQT

SEQ ID NO: 1430 - protein, 10 aa, Artificial sequence
  Synthetic peptide
STVTVFQQTQ

SEQ ID NO: 1431 - protein, 10 aa, Artificial sequence
  Synthetic peptide
TVTVFQQTQI

SEQ ID NO: 1432 - protein, 10 aa, Artificial sequence
  Synthetic peptide
VTVFQQTQIQ

SEQ ID NO: 1433 - protein, 10 aa, Artificial sequence
  Synthetic peptide
TVFQQTQIQE

SEQ ID NO: 1434 - protein, 10 aa, Artificial sequence
  Synthetic peptide
VFQQTQIQEP

SEQ ID NO: 1435 - protein, 10 aa, Artificial sequence
  Synthetic peptide
FQQTQIQEPT

SEQ ID NO: 1436 - protein, 10 aa, Artificial sequence
  Synthetic peptide
QQTQIQEPTA

SEQ ID NO: 1437 - protein, 10 aa, Artificial sequence
  Synthetic peptide
QTQIQEPTAN

SEQ ID NO: 1438 - protein, 10 aa, Artificial sequence
  Synthetic peptide
TQIQEPTANA

SEQ ID NO: 1439 - protein, 10 aa, Artificial sequence
  Synthetic peptide
QIQEPTANAT

SEQ ID NO: 1440 - protein, 10 aa, Artificial sequence
  Synthetic peptide
IQEPTANATT

SEQ ID NO: 1441 - protein, 10 aa, Artificial sequence
  Synthetic peptide
QEPTANATTT

SEQ ID NO: 1442 - protein, 10 aa, Artificial sequence
  Synthetic peptide
EPTANATTTT

SEQ ID NO: 1443 - protein, 10 aa, Artificial sequence
  Synthetic peptide
PTANATTTTA

SEQ ID NO: 1444 - protein, 10 aa, Artificial sequence
  Synthetic peptide
TANATTTTAT

SEQ ID NO: 1445 - protein, 10 aa, Artificial sequence
  Synthetic peptide
ANATTTTATT

SEQ ID NO: 1446 - protein, 10 aa, Artificial sequence
  Synthetic peptide
NATTTTATTD

SEQ ID NO: 1447 - protein, 10 aa, Artificial sequence
  Synthetic peptide
ATTTTATTDE

SEQ ID NO: 1448 - protein, 10 aa, Artificial sequence
  Synthetic peptide
TTTTATTDEL

SEQ ID NO: 1449 - protein, 10 aa, Artificial sequence
  Synthetic peptide
TTTATTDELK

SEQ ID NO: 1450 - protein, 10 aa, Artificial sequence
  Synthetic peptide
TTATTDELKT

SEQ ID NO: 1451 - protein, 10 aa, Artificial sequence
  Synthetic peptide
TATTDELKTV

SEQ ID NO: 1452 - protein, 10 aa, Artificial sequence
  Synthetic peptide
ATTDELKTVT

SEQ ID NO: 1453 - protein, 10 aa, Artificial sequence
  Synthetic peptide
TTDELKTVTK

SEQ ID NO: 1454 - protein, 10 aa, Artificial sequence
  Synthetic peptide
TDELKTVTKD

SEQ ID NO: 1455 - protein, 10 aa, Artificial sequence
  Synthetic peptide
DELKTVTKDR

SEQ ID NO: 1456 - protein, 10 aa, Artificial sequence
  Synthetic peptide
ELKTVTKDRM

SEQ ID NO: 1457 - protein, 10 aa, Artificial sequence
  Synthetic peptide
LKTVTKDRME

SEQ ID NO: 1458 - protein, 10 aa, Artificial sequence
  Synthetic peptide
KTVTKDRMED

SEQ ID NO: 1459 - protein, 10 aa, Artificial sequence
  Synthetic peptide
TVTKDRMEDI

SEQ ID NO: 1460 - protein, 10 aa, Artificial sequence
  Synthetic peptide
VTKDRMEDIK

SEQ ID NO: 1461 - protein, 10 aa, Artificial sequence
  Synthetic peptide
TKDRMEDIKI

SEQ ID NO: 1462 - protein, 10 aa, Artificial sequence
  Synthetic peptide
KDRMEDIKIL

SEQ ID NO: 1463 - protein, 10 aa, Artificial sequence
  Synthetic peptide
DRMEDIKILI

SEQ ID NO: 1464 - protein, 10 aa, Artificial sequence
  Synthetic peptide
RMEDIKILIA

SEQ ID NO: 1465 - protein, 10 aa, Artificial sequence
  Synthetic peptide
MEDIKILIAS

SEQ ID NO: 1466 - protein, 10 aa, Artificial sequence
  Synthetic peptide
EDIKILIASP

SEQ ID NO: 1467 - protein, 10 aa, Artificial sequence
  Synthetic peptide
DIKILIASPS

SEQ ID NO: 1468 - protein, 10 aa, Artificial sequence
  Synthetic peptide
IKILIASPSP

SEQ ID NO: 1469 - protein, 10 aa, Artificial sequence
  Synthetic peptide
KILIASPSPT

SEQ ID NO: 1470 - protein, 10 aa, Artificial sequence
  Synthetic peptide
ILIASPSPTH

SEQ ID NO: 1471 - protein, 10 aa, Artificial sequence
  Synthetic peptide
LIASPSPTHI

SEQ ID NO: 1472 - protein, 10 aa, Artificial sequence
  Synthetic peptide
IASPSPTHIH

SEQ ID NO: 1473 - protein, 10 aa, Artificial sequence
  Synthetic peptide
ASPSPTHIHK

SEQ ID NO: 1474 - protein, 10 aa, Artificial sequence
  Synthetic peptide
SPSPTHIHKE

SEQ ID NO: 1475 - protein, 10 aa, Artificial sequence
  Synthetic peptide
PSPTHIHKET

SEQ ID NO: 1476 - protein, 10 aa, Artificial sequence
  Synthetic peptide
SPTHIHKETT

SEQ ID NO: 1477 - protein, 10 aa, Artificial sequence
  Synthetic peptide
PTHIHKETTS

SEQ ID NO: 1478 - protein, 10 aa, Artificial sequence
  Synthetic peptide
THIHKETTSA

SEQ ID NO: 1479 - protein, 10 aa, Artificial sequence
  Synthetic peptide
HIHKETTSAT

SEQ ID NO: 1480 - protein, 10 aa, Artificial sequence
  Synthetic peptide
IHKETTSATS

SEQ ID NO: 1481 - protein, 10 aa, Artificial sequence
  Synthetic peptide
HKETTSATSS

SEQ ID NO: 1482 - protein, 10 aa, Artificial sequence
  Synthetic peptide
KETTSATSSP

SEQ ID NO: 1483 - protein, 10 aa, Artificial sequence
  Synthetic peptide
ETTSATSSPY

SEQ ID NO: 1484 - protein, 10 aa, Artificial sequence
  Synthetic peptide
TTSATSSPYR

SEQ ID NO: 1485 - protein, 10 aa, Artificial sequence
  Synthetic peptide
TSATSSPYRD

SEQ ID NO: 1486 - protein, 10 aa, Artificial sequence
  Synthetic peptide
SATSSPYRDT

SEQ ID NO: 1487 - protein, 10 aa, Artificial sequence
  Synthetic peptide
ATSSPYRDTQ

SEQ ID NO: 1488 - protein, 10 aa, Artificial sequence
  Synthetic peptide
TSSPYRDTQS

SEQ ID NO: 1489 - protein, 10 aa, Artificial sequence
  Synthetic peptide
SSPYRDTQSR

SEQ ID NO: 1490 - protein, 10 aa, Artificial sequence
  Synthetic peptide
SPYRDTQSRT

SEQ ID NO: 1491 - protein, 10 aa, Artificial sequence
  Synthetic peptide
PYRDTQSRTA

SEQ ID NO: 1492 - protein, 10 aa, Artificial sequence
  Synthetic peptide
YRDTQSRTAS

SEQ ID NO: 1493 - protein, 10 aa, Artificial sequence
  Synthetic peptide
RDTQSRTASP

SEQ ID NO: 1494 - protein, 10 aa, Artificial sequence
  Synthetic peptide
DTQSRTASPN

SEQ ID NO: 1495 - protein, 10 aa, Artificial sequence
  Synthetic peptide
TQSRTASPNR

SEQ ID NO: 1496 - protein, 10 aa, Artificial sequence
  Synthetic peptide
QSRTASPNRA

SEQ ID NO: 1497 - protein, 10 aa, Artificial sequence
  Synthetic peptide
SRTASPNRAG

SEQ ID NO: 1498 - protein, 10 aa, Artificial sequence
  Synthetic peptide
RTASPNRAGK

SEQ ID NO: 1499 - protein, 10 aa, Artificial sequence
  Synthetic peptide
TASPNRAGKG

SEQ ID NO: 1500 - protein, 10 aa, Artificial sequence
  Synthetic peptide
ASPNRAGKGV

SEQ ID NO: 1501 - protein, 10 aa, Artificial sequence
  Synthetic peptide
SPNRAGKGVI

SEQ ID NO: 1502 - protein, 10 aa, Artificial sequence
  Synthetic peptide
PNRAGKGVIE

SEQ ID NO: 1503 - protein, 10 aa, Artificial sequence
  Synthetic peptide
NRAGKGVIEQ

SEQ ID NO: 1504 - protein, 10 aa, Artificial sequence
  Synthetic peptide
RAGKGVIEQT

SEQ ID NO: 1505 - protein, 10 aa, Artificial sequence
  Synthetic peptide
AGKGVIEQTE

SEQ ID NO: 1506 - protein, 10 aa, Artificial sequence
  Synthetic peptide
GKGVIEQTEK

SEQ ID NO: 1507 - protein, 10 aa, Artificial sequence
  Synthetic peptide
KGVIEQTEKS

SEQ ID NO: 1508 - protein, 10 aa, Artificial sequence
  Synthetic peptide
GVIEQTEKSH

SEQ ID NO: 1509 - protein, 10 aa, Artificial sequence
  Synthetic peptide
VIEQTEKSHP

SEQ ID NO: 1510 - protein, 10 aa, Artificial sequence
  Synthetic peptide
IEQTEKSHPR

SEQ ID NO: 1511 - protein, 10 aa, Artificial sequence
  Synthetic peptide
EQTEKSHPRS

SEQ ID NO: 1512 - protein, 10 aa, Artificial sequence
  Synthetic peptide
QTEKSHPRSP

SEQ ID NO: 1513 - protein, 10 aa, Artificial sequence
  Synthetic peptide
TEKSHPRSPN

SEQ ID NO: 1514 - protein, 10 aa, Artificial sequence
  Synthetic peptide
EKSHPRSPNV

SEQ ID NO: 1515 - protein, 10 aa, Artificial sequence
  Synthetic peptide
KSHPRSPNVL

SEQ ID NO: 1516 - protein, 10 aa, Artificial sequence
  Synthetic peptide
SHPRSPNVLS

SEQ ID NO: 1517 - protein, 10 aa, Artificial sequence
  Synthetic peptide
HPRSPNVLSV

SEQ ID NO: 1518 - protein, 10 aa, Artificial sequence
  Synthetic peptide
PRSPNVLSVA

SEQ ID NO: 1519 - protein, 10 aa, Artificial sequence
  Synthetic peptide
RSPNVLSVAL

SEQ ID NO: 1520 - protein, 10 aa, Artificial sequence
  Synthetic peptide
SPNVLSVALS

SEQ ID NO: 1521 - protein, 10 aa, Artificial sequence
  Synthetic peptide
PNVLSVALSQ

SEQ ID NO: 1522 - protein, 10 aa, Artificial sequence
  Synthetic peptide
NVLSVALSQR

SEQ ID NO: 1523 - protein, 10 aa, Artificial sequence
  Synthetic peptide
VLSVALSQRT

SEQ ID NO: 1524 - protein, 10 aa, Artificial sequence
  Synthetic peptide
LSVALSQRTT

SEQ ID NO: 1525 - protein, 10 aa, Artificial sequence
  Synthetic peptide
SVALSQRTTV

SEQ ID NO: 1526 - protein, 10 aa, Artificial sequence
  Synthetic peptide
VALSQRTTVP

SEQ ID NO: 1527 - protein, 10 aa, Artificial sequence
  Synthetic peptide
ALSQRTTVPE

SEQ ID NO: 1528 - protein, 10 aa, Artificial sequence
  Synthetic peptide
LSQRTTVPEE

SEQ ID NO: 1529 - protein, 10 aa, Artificial sequence
  Synthetic peptide
SQRTTVPEEE

SEQ ID NO: 1530 - protein, 10 aa, Artificial sequence
  Synthetic peptide
QRTTVPEEEL

SEQ ID NO: 1531 - protein, 10 aa, Artificial sequence
  Synthetic peptide
RTTVPEEELN

SEQ ID NO: 1532 - protein, 10 aa, Artificial sequence
  Synthetic peptide
TTVPEEELNP

SEQ ID NO: 1533 - protein, 10 aa, Artificial sequence
  Synthetic peptide
TVPEEELNPK

SEQ ID NO: 1534 - protein, 10 aa, Artificial sequence
  Synthetic peptide
VPEEELNPKI

SEQ ID NO: 1535 - protein, 10 aa, Artificial sequence
  Synthetic peptide
PEEELNPKIL

SEQ ID NO: 1536 - protein, 10 aa, Artificial sequence
  Synthetic peptide
EEELNPKILA

SEQ ID NO: 1537 - protein, 10 aa, Artificial sequence
  Synthetic peptide
EELNPKILAL

SEQ ID NO: 1538 - protein, 10 aa, Artificial sequence
  Synthetic peptide
ELNPKILALQ

SEQ ID NO: 1539 - protein, 10 aa, Artificial sequence
  Synthetic peptide
LNPKILALQN

SEQ ID NO: 1540 - protein, 10 aa, Artificial sequence
  Synthetic peptide
NPKILALQNA

SEQ ID NO: 1541 - protein, 10 aa, Artificial sequence
  Synthetic peptide
PKILALQNAQ

SEQ ID NO: 1542 - protein, 10 aa, Artificial sequence
  Synthetic peptide
KILALQNAQR

SEQ ID NO: 1543 - protein, 10 aa, Artificial sequence
  Synthetic peptide
ILALQNAQRK

SEQ ID NO: 1544 - protein, 10 aa, Artificial sequence
  Synthetic peptide
LALQNAQRKR

SEQ ID NO: 1545 - protein, 10 aa, Artificial sequence
  Synthetic peptide
ALQNAQRKRK

SEQ ID NO: 1546 - protein, 10 aa, Artificial sequence
  Synthetic peptide
LQNAQRKRKM

SEQ ID NO: 1547 - protein, 10 aa, Artificial sequence
  Synthetic peptide
QNAQRKRKME

SEQ ID NO: 1548 - protein, 10 aa, Artificial sequence
  Synthetic peptide
NAQRKRKMEH

SEQ ID NO: 1549 - protein, 10 aa, Artificial sequence
  Synthetic peptide
AQRKRKMEHD

SEQ ID NO: 1550 - protein, 10 aa, Artificial sequence
  Synthetic peptide
QRKRKMEHDG

SEQ ID NO: 1551 - protein, 10 aa, Artificial sequence
  Synthetic peptide
RKRKMEHDGS

SEQ ID NO: 1552 - protein, 10 aa, Artificial sequence
  Synthetic peptide
KRKMEHDGSL

SEQ ID NO: 1553 - protein, 10 aa, Artificial sequence
  Synthetic peptide
RKMEHDGSLF

SEQ ID NO: 1554 - protein, 10 aa, Artificial sequence
  Synthetic peptide
KMEHDGSLFQ

SEQ ID NO: 1555 - protein, 10 aa, Artificial sequence
  Synthetic peptide
MEHDGSLFQA

SEQ ID NO: 1556 - protein, 10 aa, Artificial sequence
  Synthetic peptide
EHDGSLFQAV

SEQ ID NO: 1557 - protein, 10 aa, Artificial sequence
  Synthetic peptide
HDGSLFQAVG

SEQ ID NO: 1558 - protein, 10 aa, Artificial sequence
  Synthetic peptide
DGSLFQAVGI

SEQ ID NO: 1559 - protein, 10 aa, Artificial sequence
  Synthetic peptide
GSLFQAVGIG

SEQ ID NO: 1560 - protein, 10 aa, Artificial sequence
  Synthetic peptide
SLFQAVGIGT

SEQ ID NO: 1561 - protein, 10 aa, Artificial sequence
  Synthetic peptide
LFQAVGIGTL

SEQ ID NO: 1562 - protein, 10 aa, Artificial sequence
  Synthetic peptide
FQAVGIGTLL

SEQ ID NO: 1563 - protein, 10 aa, Artificial sequence
  Synthetic peptide
QAVGIGTLLQ

SEQ ID NO: 1564 - protein, 10 aa, Artificial sequence
  Synthetic peptide
AVGIGTLLQQ

SEQ ID NO: 1565 - protein, 10 aa, Artificial sequence
  Synthetic peptide
VGIGTLLQQP

SEQ ID NO: 1566 - protein, 10 aa, Artificial sequence
  Synthetic peptide
GIGTLLQQPD

SEQ ID NO: 1567 - protein, 10 aa, Artificial sequence
  Synthetic peptide
IGTLLQQPDD

SEQ ID NO: 1568 - protein, 10 aa, Artificial sequence
  Synthetic peptide
GTLLQQPDDH

SEQ ID NO: 1569 - protein, 10 aa, Artificial sequence
  Synthetic peptide
TLLQQPDDHA

SEQ ID NO: 1570 - protein, 10 aa, Artificial sequence
  Synthetic peptide
LLQQPDDHAA

SEQ ID NO: 1571 - protein, 10 aa, Artificial sequence
  Synthetic peptide
LQQPDDHAAT

SEQ ID NO: 1572 - protein, 10 aa, Artificial sequence
  Synthetic peptide
QQPDDHAATT

SEQ ID NO: 1573 - protein, 10 aa, Artificial sequence
  Synthetic peptide
QPDDHAATTS

SEQ ID NO: 1574 - protein, 10 aa, Artificial sequence
  Synthetic peptide
PDDHAATTSL

SEQ ID NO: 1575 - protein, 10 aa, Artificial sequence
  Synthetic peptide
DDHAATTSLS

SEQ ID NO: 1576 - protein, 10 aa, Artificial sequence
  Synthetic peptide
DHAATTSLSW

SEQ ID NO: 1577 - protein, 10 aa, Artificial sequence
  Synthetic peptide
HAATTSLSWK

SEQ ID NO: 1578 - protein, 10 aa, Artificial sequence
  Synthetic peptide
AATTSLSWKR

SEQ ID NO: 1579 - protein, 10 aa, Artificial sequence
  Synthetic peptide
ATTSLSWKRV

SEQ ID NO: 1580 - protein, 10 aa, Artificial sequence
  Synthetic peptide
TTSLSWKRVK

SEQ ID NO: 1581 - protein, 10 aa, Artificial sequence
  Synthetic peptide
TSLSWKRVKG

SEQ ID NO: 1582 - protein, 10 aa, Artificial sequence
  Synthetic peptide
SLSWKRVKGC

SEQ ID NO: 1583 - protein, 10 aa, Artificial sequence
  Synthetic peptide
LSWKRVKGCK

SEQ ID NO: 1584 - protein, 10 aa, Artificial sequence
  Synthetic peptide
SWKRVKGCKS

SEQ ID NO: 1585 - protein, 10 aa, Artificial sequence
  Synthetic peptide
WKRVKGCKSS

SEQ ID NO: 1586 - protein, 10 aa, Artificial sequence
  Synthetic peptide
KRVKGCKSSE

SEQ ID NO: 1587 - protein, 10 aa, Artificial sequence
  Synthetic peptide
RVKGCKSSEQ

SEQ ID NO: 1588 - protein, 10 aa, Artificial sequence
  Synthetic peptide
VKGCKSSEQN

SEQ ID NO: 1589 - protein, 10 aa, Artificial sequence
  Synthetic peptide
KGCKSSEQNG

SEQ ID NO: 1590 - protein, 10 aa, Artificial sequence
  Synthetic peptide
GCKSSEQNGM

SEQ ID NO: 1591 - protein, 10 aa, Artificial sequence
  Synthetic peptide
CKSSEQNGME

SEQ ID NO: 1592 - protein, 10 aa, Artificial sequence
  Synthetic peptide
KSSEQNGMEQ

SEQ ID NO: 1593 - protein, 10 aa, Artificial sequence
  Synthetic peptide
SSEQNGMEQK

SEQ ID NO: 1594 - protein, 10 aa, Artificial sequence
  Synthetic peptide
SEQNGMEQKT

SEQ ID NO: 1595 - protein, 10 aa, Artificial sequence
  Synthetic peptide
EQNGMEQKTI

SEQ ID NO: 1596 - protein, 10 aa, Artificial sequence
  Synthetic peptide
QNGMEQKTII

SEQ ID NO: 1597 - protein, 10 aa, Artificial sequence
  Synthetic peptide
NGMEQKTIIL

SEQ ID NO: 1598 - protein, 10 aa, Artificial sequence
  Synthetic peptide
GMEQKTIILI

SEQ ID NO: 1599 - protein, 10 aa, Artificial sequence
  Synthetic peptide
MEQKTIILIP

SEQ ID NO: 1600 - protein, 10 aa, Artificial sequence
  Synthetic peptide
EQKTIILIPS

SEQ ID NO: 1601 - protein, 10 aa, Artificial sequence
  Synthetic peptide
QKTIILIPSD

SEQ ID NO: 1602 - protein, 10 aa, Artificial sequence
  Synthetic peptide
KTIILIPSDL

SEQ ID NO: 1603 - protein, 10 aa, Artificial sequence
  Synthetic peptide
TIILIPSDLA

SEQ ID NO: 1604 - protein, 10 aa, Artificial sequence
  Synthetic peptide
IILIPSDLAC

SEQ ID NO: 1605 - protein, 10 aa, Artificial sequence
  Synthetic peptide
ILIPSDLACR

SEQ ID NO: 1606 - protein, 10 aa, Artificial sequence
  Synthetic peptide
LIPSDLACRL

SEQ ID NO: 1607 - protein, 10 aa, Artificial sequence
  Synthetic peptide
IPSDLACRLL

SEQ ID NO: 1608 - protein, 10 aa, Artificial sequence
  Synthetic peptide
PSDLACRLLG

SEQ ID NO: 1609 - protein, 10 aa, Artificial sequence
  Synthetic peptide
SDLACRLLGQ

SEQ ID NO: 1610 - protein, 10 aa, Artificial sequence
  Synthetic peptide
DLACRLLGQS

SEQ ID NO: 1611 - protein, 10 aa, Artificial sequence
  Synthetic peptide
LACRLLGQSM

SEQ ID NO: 1612 - protein, 10 aa, Artificial sequence
  Synthetic peptide
ACRLLGQSMD

SEQ ID NO: 1613 - protein, 10 aa, Artificial sequence
  Synthetic peptide
CRLLGQSMDE

SEQ ID NO: 1614 - protein, 10 aa, Artificial sequence
  Synthetic peptide
RLLGQSMDES

SEQ ID NO: 1615 - protein, 10 aa, Artificial sequence
  Synthetic peptide
LLGQSMDESG

SEQ ID NO: 1616 - protein, 10 aa, Artificial sequence
  Synthetic peptide
LGQSMDESGL

SEQ ID NO: 1617 - protein, 10 aa, Artificial sequence
  Synthetic peptide
GQSMDESGLP

SEQ ID NO: 1618 - protein, 10 aa, Artificial sequence
  Synthetic peptide
QSMDESGLPQ

SEQ ID NO: 1619 - protein, 10 aa, Artificial sequence
  Synthetic peptide
SMDESGLPQL

SEQ ID NO: 1620 - protein, 10 aa, Artificial sequence
  Synthetic peptide
MDESGLPQLT

SEQ ID NO: 1621 - protein, 10 aa, Artificial sequence
  Synthetic peptide
DESGLPQLTS

SEQ ID NO: 1622 - protein, 10 aa, Artificial sequence
  Synthetic peptide
ESGLPQLTSY

SEQ ID NO: 1623 - protein, 10 aa, Artificial sequence
  Synthetic peptide
SGLPQLTSYD

SEQ ID NO: 1624 - protein, 10 aa, Artificial sequence
  Synthetic peptide
GLPQLTSYDC

SEQ ID NO: 1625 - protein, 10 aa, Artificial sequence
  Synthetic peptide
LPQLTSYDCE

SEQ ID NO: 1626 - protein, 10 aa, Artificial sequence
  Synthetic peptide
PQLTSYDCEV

SEQ ID NO: 1627 - protein, 10 aa, Artificial sequence
  Synthetic peptide
QLTSYDCEVN

SEQ ID NO: 1628 - protein, 10 aa, Artificial sequence
  Synthetic peptide
LTSYDCEVNA

SEQ ID NO: 1629 - protein, 10 aa, Artificial sequence
  Synthetic peptide
TSYDCEVNAP

SEQ ID NO: 1630 - protein, 10 aa, Artificial sequence
  Synthetic peptide
SYDCEVNAPI

SEQ ID NO: 1631 - protein, 10 aa, Artificial sequence
  Synthetic peptide
YDCEVNAPIQ

SEQ ID NO: 1632 - protein, 10 aa, Artificial sequence
  Synthetic peptide
DCEVNAPIQG

SEQ ID NO: 1633 - protein, 10 aa, Artificial sequence
  Synthetic peptide
CEVNAPIQGS

SEQ ID NO: 1634 - protein, 10 aa, Artificial sequence
  Synthetic peptide
EVNAPIQGSR

SEQ ID NO: 1635 - protein, 10 aa, Artificial sequence
  Synthetic peptide
VNAPIQGSRN

SEQ ID NO: 1636 - protein, 10 aa, Artificial sequence
  Synthetic peptide
NAPIQGSRNL

SEQ ID NO: 1637 - protein, 10 aa, Artificial sequence
  Synthetic peptide
APIQGSRNLL

SEQ ID NO: 1638 - protein, 10 aa, Artificial sequence
  Synthetic peptide
PIQGSRNLLQ

SEQ ID NO: 1639 - protein, 10 aa, Artificial sequence
  Synthetic peptide
IQGSRNLLQG

SEQ ID NO: 1640 - protein, 10 aa, Artificial sequence
  Synthetic peptide
QGSRNLLQGE

SEQ ID NO: 1641 - protein, 10 aa, Artificial sequence
  Synthetic peptide
GSRNLLQGEE

SEQ ID NO: 1642 - protein, 10 aa, Artificial sequence
  Synthetic peptide
SRNLLQGEEL

SEQ ID NO: 1643 - protein, 10 aa, Artificial sequence
  Synthetic peptide
RNLLQGEELL

SEQ ID NO: 1644 - protein, 10 aa, Artificial sequence
  Synthetic peptide
NLLQGEELLR

SEQ ID NO: 1645 - protein, 10 aa, Artificial sequence
  Synthetic peptide
LLQGEELLRA

SEQ ID NO: 1646 - protein, 10 aa, Artificial sequence
  Synthetic peptide
LQGEELLRAL

SEQ ID NO: 1647 - protein, 10 aa, Artificial sequence
  Synthetic peptide
QGEELLRALD

SEQ ID NO: 1648 - protein, 10 aa, Artificial sequence
  Synthetic peptide
GEELLRALDQ

SEQ ID NO: 1649 - protein, 10 aa, Artificial sequence
  Synthetic peptide
EELLRALDQV

SEQ ID NO: 1650 - protein, 10 aa, Artificial sequence
  Synthetic peptide
ELLRALDQVN

SEQ ID NO: 1651 - protein, 15 aa, Artificial sequence
  Synthetic peptide
MEGAGGANDKKKISS

SEQ ID NO: 1652 - protein, 15 aa, Artificial sequence
  Synthetic peptide
EGAGGANDKKKISSE

SEQ ID NO: 1653 - protein, 15 aa, Artificial sequence
  Synthetic peptide
GAGGANDKKKISSER

SEQ ID NO: 1654 - protein, 15 aa, Artificial sequence
  Synthetic peptide
AGGANDKKKISSERR

SEQ ID NO: 1655 - protein, 15 aa, Artificial sequence
  Synthetic peptide
GGANDKKKISSERRK

SEQ ID NO: 1656 - protein, 15 aa, Artificial sequence
  Synthetic peptide
GANDKKKISSERRKE

SEQ ID NO: 1657 - protein, 15 aa, Artificial sequence
  Synthetic peptide
ANDKKKISSERRKEK

SEQ ID NO: 1658 - protein, 15 aa, Artificial sequence
  Synthetic peptide
NDKKKISSERRKEKS

SEQ ID NO: 1659 - protein, 15 aa, Artificial sequence
  Synthetic peptide
DKKKISSERRKEKSR

SEQ ID NO: 1660 - protein, 15 aa, Artificial sequence
  Synthetic peptide
KKKISSERRKEKSRD

SEQ ID NO: 1661 - protein, 15 aa, Artificial sequence
  Synthetic peptide
KKISSERRKEKSRDA

SEQ ID NO: 1662 - protein, 15 aa, Artificial sequence
  Synthetic peptide
KISSERRKEKSRDAA

SEQ ID NO: 1663 - protein, 15 aa, Artificial sequence
  Synthetic peptide
ISSERRKEKSRDAAR

SEQ ID NO: 1664 - protein, 15 aa, Artificial sequence
  Synthetic peptide
SSERRKEKSRDAARS

SEQ ID NO: 1665 - protein, 15 aa, Artificial sequence
  Synthetic peptide
SERRKEKSRDAARSR

SEQ ID NO: 1666 - protein, 15 aa, Artificial sequence
  Synthetic peptide
ERRKEKSRDAARSRR

SEQ ID NO: 1667 - protein, 15 aa, Artificial sequence
  Synthetic peptide
RRKEKSRDAARSRRS

SEQ ID NO: 1668 - protein, 15 aa, Artificial sequence
  Synthetic peptide
RKEKSRDAARSRRSK

SEQ ID NO: 1669 - protein, 15 aa, Artificial sequence
  Synthetic peptide
KEKSRDAARSRRSKE

SEQ ID NO: 1670 - protein, 15 aa, Artificial sequence
  Synthetic peptide
EKSRDAARSRRSKES

SEQ ID NO: 1671 - protein, 15 aa, Artificial sequence
  Synthetic peptide
KSRDAARSRRSKESE

SEQ ID NO: 1672 - protein, 15 aa, Artificial sequence
  Synthetic peptide
SRDAARSRRSKESEV

SEQ ID NO: 1673 - protein, 15 aa, Artificial sequence
  Synthetic peptide
RDAARSRRSKESEVF

SEQ ID NO: 1674 - protein, 15 aa, Artificial sequence
  Synthetic peptide
DAARSRRSKESEVFY

SEQ ID NO: 1675 - protein, 15 aa, Artificial sequence
  Synthetic peptide
AARSRRSKESEVFYE

SEQ ID NO: 1676 - protein, 15 aa, Artificial sequence
  Synthetic peptide
ARSRRSKESEVFYEL

SEQ ID NO: 1677 - protein, 15 aa, Artificial sequence
  Synthetic peptide
RSRRSKESEVFYELA

SEQ ID NO: 1678 - protein, 15 aa, Artificial sequence
  Synthetic peptide
SRRSKESEVFYELAH

SEQ ID NO: 1679 - protein, 15 aa, Artificial sequence
  Synthetic peptide
RRSKESEVFYELAHQ

SEQ ID NO: 1680 - protein, 15 aa, Artificial sequence
  Synthetic peptide
RSKESEVFYELAHQL

SEQ ID NO: 1681 - protein, 15 aa, Artificial sequence
  Synthetic peptide
SKESEVFYELAHQLP

SEQ ID NO: 1682 - protein, 15 aa, Artificial sequence
  Synthetic peptide
KESEVFYELAHQLPL

SEQ ID NO: 1683 - protein, 15 aa, Artificial sequence
  Synthetic peptide
ESEVFYELAHQLPLP

SEQ ID NO: 1684 - protein, 15 aa, Artificial sequence
  Synthetic peptide
SEVFYELAHQLPLPH

SEQ ID NO: 1685 - protein, 15 aa, Artificial sequence
  Synthetic peptide
EVFYELAHQLPLPHN

SEQ ID NO: 1686 - protein, 15 aa, Artificial sequence
  Synthetic peptide
VFYELAHQLPLPHNV

SEQ ID NO: 1687 - protein, 15 aa, Artificial sequence
  Synthetic peptide
FYELAHQLPLPHNVS

SEQ ID NO: 1688 - protein, 15 aa, Artificial sequence
  Synthetic peptide
YELAHQLPLPHNVSS

SEQ ID NO: 1689 - protein, 15 aa, Artificial sequence
  Synthetic peptide
ELAHQLPLPHNVSSH

SEQ ID NO: 1690 - protein, 15 aa, Artificial sequence
  Synthetic peptide
LAHQLPLPHNVSSHL

SEQ ID NO: 1691 - protein, 15 aa, Artificial sequence
  Synthetic peptide
AHQLPLPHNVSSHLD

SEQ ID NO: 1692 - protein, 15 aa, Artificial sequence
  Synthetic peptide
HQLPLPHNVSSHLDK

SEQ ID NO: 1693 - protein, 15 aa, Artificial sequence
  Synthetic peptide
QLPLPHNVSSHLDKA

SEQ ID NO: 1694 - protein, 15 aa, Artificial sequence
  Synthetic peptide
LPLPHNVSSHLDKAS

SEQ ID NO: 1695 - protein, 15 aa, Artificial sequence
  Synthetic peptide
PLPHNVSSHLDKASV

SEQ ID NO: 1696 - protein, 15 aa, Artificial sequence
  Synthetic peptide
LPHNVSSHLDKASVM

SEQ ID NO: 1697 - protein, 15 aa, Artificial sequence
  Synthetic peptide
PHNVSSHLDKASVMR

SEQ ID NO: 1698 - protein, 15 aa, Artificial sequence
  Synthetic peptide
HNVSSHLDKASVMRL

SEQ ID NO: 1699 - protein, 15 aa, Artificial sequence
  Synthetic peptide
NVSSHLDKASVMRLT

SEQ ID NO: 1700 - protein, 15 aa, Artificial sequence
  Synthetic peptide
VSSHLDKASVMRLTI

SEQ ID NO: 1701 - protein, 15 aa, Artificial sequence
  Synthetic peptide
SSHLDKASVMRLTIS

SEQ ID NO: 1702 - protein, 15 aa, Artificial sequence
  Synthetic peptide
SHLDKASVMRLTISY

SEQ ID NO: 1703 - protein, 15 aa, Artificial sequence
  Synthetic peptide
HLDKASVMRLTISYL

SEQ ID NO: 1704 - protein, 15 aa, Artificial sequence
  Synthetic peptide
LDKASVMRLTISYLR

SEQ ID NO: 1705 - protein, 15 aa, Artificial sequence
  Synthetic peptide
DKASVMRLTISYLRV

SEQ ID NO: 1706 - protein, 15 aa, Artificial sequence
  Synthetic peptide
KASVMRLTISYLRVR

SEQ ID NO: 1707 - protein, 15 aa, Artificial sequence
  Synthetic peptide
ASVMRLTISYLRVRK

SEQ ID NO: 1708 - protein, 15 aa, Artificial sequence
  Synthetic peptide
SVMRLTISYLRVRKL

SEQ ID NO: 1709 - protein, 15 aa, Artificial sequence
  Synthetic peptide
VMRLTISYLRVRKLL

SEQ ID NO: 1710 - protein, 15 aa, Artificial sequence
  Synthetic peptide
MRLTISYLRVRKLLD

SEQ ID NO: 1711 - protein, 15 aa, Artificial sequence
  Synthetic peptide
RLTISYLRVRKLLDA

SEQ ID NO: 1712 - protein, 15 aa, Artificial sequence
  Synthetic peptide
LTISYLRVRKLLDAG

SEQ ID NO: 1713 - protein, 15 aa, Artificial sequence
  Synthetic peptide
TISYLRVRKLLDAGD

SEQ ID NO: 1714 - protein, 15 aa, Artificial sequence
  Synthetic peptide
ISYLRVRKLLDAGDL

SEQ ID NO: 1715 - protein, 15 aa, Artificial sequence
  Synthetic peptide
SYLRVRKLLDAGDLD

SEQ ID NO: 1716 - protein, 15 aa, Artificial sequence
  Synthetic peptide
YLRVRKLLDAGDLDI

SEQ ID NO: 1717 - protein, 15 aa, Artificial sequence
  Synthetic peptide
LRVRKLLDAGDLDIE

SEQ ID NO: 1718 - protein, 15 aa, Artificial sequence
  Synthetic peptide
RVRKLLDAGDLDIED

SEQ ID NO: 1719 - protein, 15 aa, Artificial sequence
  Synthetic peptide
VRKLLDAGDLDIEDD

SEQ ID NO: 1720 - protein, 15 aa, Artificial sequence
  Synthetic peptide
RKLLDAGDLDIEDDM

SEQ ID NO: 1721 - protein, 15 aa, Artificial sequence
  Synthetic peptide
KLLDAGDLDIEDDMK

SEQ ID NO: 1722 - protein, 15 aa, Artificial sequence
  Synthetic peptide
LLDAGDLDIEDDMKA

SEQ ID NO: 1723 - protein, 15 aa, Artificial sequence
  Synthetic peptide
LDAGDLDIEDDMKAQ

SEQ ID NO: 1724 - protein, 15 aa, Artificial sequence
  Synthetic peptide
DAGDLDIEDDMKAQM

SEQ ID NO: 1725 - protein, 15 aa, Artificial sequence
  Synthetic peptide
AGDLDIEDDMKAQMN

SEQ ID NO: 1726 - protein, 15 aa, Artificial sequence
  Synthetic peptide
GDLDIEDDMKAQMNC

SEQ ID NO: 1727 - protein, 15 aa, Artificial sequence
  Synthetic peptide
DLDIEDDMKAQMNCF

SEQ ID NO: 1728 - protein, 15 aa, Artificial sequence
  Synthetic peptide
LDIEDDMKAQMNCFY

SEQ ID NO: 1729 - protein, 15 aa, Artificial sequence
  Synthetic peptide
DIEDDMKAQMNCFYL

SEQ ID NO: 1730 - protein, 15 aa, Artificial sequence
  Synthetic peptide
IEDDMKAQMNCFYLK

SEQ ID NO: 1731 - protein, 15 aa, Artificial sequence
  Synthetic peptide
EDDMKAQMNCFYLKA

SEQ ID NO: 1732 - protein, 15 aa, Artificial sequence
  Synthetic peptide
DDMKAQMNCFYLKAL

SEQ ID NO: 1733 - protein, 15 aa, Artificial sequence
  Synthetic peptide
DMKAQMNCFYLKALD

SEQ ID NO: 1734 - protein, 15 aa, Artificial sequence
  Synthetic peptide
MKAQMNCFYLKALDG

SEQ ID NO: 1735 - protein, 15 aa, Artificial sequence
  Synthetic peptide
KAQMNCFYLKALDGF

SEQ ID NO: 1736 - protein, 15 aa, Artificial sequence
  Synthetic peptide
AQMNCFYLKALDGFV

SEQ ID NO: 1737 - protein, 15 aa, Artificial sequence
  Synthetic peptide
QMNCFYLKALDGFVM

SEQ ID NO: 1738 - protein, 15 aa, Artificial sequence
  Synthetic peptide
MNCFYLKALDGFVMV

SEQ ID NO: 1739 - protein, 15 aa, Artificial sequence
  Synthetic peptide
NCFYLKALDGFVMVL

SEQ ID NO: 1740 - protein, 15 aa, Artificial sequence
  Synthetic peptide
CFYLKALDGFVMVLT

SEQ ID NO: 1741 - protein, 15 aa, Artificial sequence
  Synthetic peptide
FYLKALDGFVMVLTD

SEQ ID NO: 1742 - protein, 15 aa, Artificial sequence
  Synthetic peptide
YLKALDGFVMVLTDD

SEQ ID NO: 1743 - protein, 15 aa, Artificial sequence
  Synthetic peptide
LKALDGFVMVLTDDG

SEQ ID NO: 1744 - protein, 15 aa, Artificial sequence
  Synthetic peptide
KALDGFVMVLTDDGD

SEQ ID NO: 1745 - protein, 15 aa, Artificial sequence
  Synthetic peptide
ALDGFVMVLTDDGDM

SEQ ID NO: 1746 - protein, 15 aa, Artificial sequence
  Synthetic peptide
LDGFVMVLTDDGDMI

SEQ ID NO: 1747 - protein, 15 aa, Artificial sequence
  Synthetic peptide
DGFVMVLTDDGDMIY

SEQ ID NO: 1748 - protein, 15 aa, Artificial sequence
  Synthetic peptide
GFVMVLTDDGDMIYI

SEQ ID NO: 1749 - protein, 15 aa, Artificial sequence
  Synthetic peptide
FVMVLTDDGDMIYIS

SEQ ID NO: 1750 - protein, 15 aa, Artificial sequence
  Synthetic peptide
VMVLTDDGDMIYISD

SEQ ID NO: 1751 - protein, 15 aa, Artificial sequence
  Synthetic peptide
MVLTDDGDMIYISDN

SEQ ID NO: 1752 - protein, 15 aa, Artificial sequence
  Synthetic peptide
VLTDDGDMIYISDNV

SEQ ID NO: 1753 - protein, 15 aa, Artificial sequence
  Synthetic peptide
LTDDGDMIYISDNVN

SEQ ID NO: 1754 - protein, 15 aa, Artificial sequence
  Synthetic peptide
TDDGDMIYISDNVNK

SEQ ID NO: 1755 - protein, 15 aa, Artificial sequence
  Synthetic peptide
DDGDMIYISDNVNKY

SEQ ID NO: 1756 - protein, 15 aa, Artificial sequence
  Synthetic peptide
DGDMIYISDNVNKYM

SEQ ID NO: 1757 - protein, 15 aa, Artificial sequence
  Synthetic peptide
GDMIYISDNVNKYMG

SEQ ID NO: 1758 - protein, 15 aa, Artificial sequence
  Synthetic peptide
DMIYISDNVNKYMGL

SEQ ID NO: 1759 - protein, 15 aa, Artificial sequence
  Synthetic peptide
MIYISDNVNKYMGLT

SEQ ID NO: 1760 - protein, 15 aa, Artificial sequence
  Synthetic peptide
IYISDNVNKYMGLTQ

SEQ ID NO: 1761 - protein, 15 aa, Artificial sequence
  Synthetic peptide
YISDNVNKYMGLTQF

SEQ ID NO: 1762 - protein, 15 aa, Artificial sequence
  Synthetic peptide
ISDNVNKYMGLTQFE

SEQ ID NO: 1763 - protein, 15 aa, Artificial sequence
  Synthetic peptide
SDNVNKYMGLTQFEL

SEQ ID NO: 1764 - protein, 15 aa, Artificial sequence
  Synthetic peptide
DNVNKYMGLTQFELT

SEQ ID NO: 1765 - protein, 15 aa, Artificial sequence
  Synthetic peptide
NVNKYMGLTQFELTG

SEQ ID NO: 1766 - protein, 15 aa, Artificial sequence
  Synthetic peptide
VNKYMGLTQFELTGH

SEQ ID NO: 1767 - protein, 15 aa, Artificial sequence
  Synthetic peptide
NKYMGLTQFELTGHS

SEQ ID NO: 1768 - protein, 15 aa, Artificial sequence
  Synthetic peptide
KYMGLTQFELTGHSV

SEQ ID NO: 1769 - protein, 15 aa, Artificial sequence
  Synthetic peptide
YMGLTQFELTGHSVF

SEQ ID NO: 1770 - protein, 15 aa, Artificial sequence
  Synthetic peptide
MGLTQFELTGHSVFD

SEQ ID NO: 1771 - protein, 15 aa, Artificial sequence
  Synthetic peptide
GLTQFELTGHSVFDF

SEQ ID NO: 1772 - protein, 15 aa, Artificial sequence
  Synthetic peptide
LTQFELTGHSVFDFT

SEQ ID NO: 1773 - protein, 15 aa, Artificial sequence
  Synthetic peptide
TQFELTGHSVFDFTH

SEQ ID NO: 1774 - protein, 15 aa, Artificial sequence
  Synthetic peptide
QFELTGHSVFDFTHP

SEQ ID NO: 1775 - protein, 15 aa, Artificial sequence
  Synthetic peptide
FELTGHSVFDFTHPC

SEQ ID NO: 1776 - protein, 15 aa, Artificial sequence
  Synthetic peptide
ELTGHSVFDFTHPCD

SEQ ID NO: 1777 - protein, 15 aa, Artificial sequence
  Synthetic peptide
LTGHSVFDFTHPCDH

SEQ ID NO: 1778 - protein, 15 aa, Artificial sequence
  Synthetic peptide
TGHSVFDFTHPCDHE

SEQ ID NO: 1779 - protein, 15 aa, Artificial sequence
  Synthetic peptide
GHSVFDFTHPCDHEE

SEQ ID NO: 1780 - protein, 15 aa, Artificial sequence
  Synthetic peptide
HSVFDFTHPCDHEEM

SEQ ID NO: 1781 - protein, 15 aa, Artificial sequence
  Synthetic peptide
SVFDFTHPCDHEEMR

SEQ ID NO: 1782 - protein, 15 aa, Artificial sequence
  Synthetic peptide
VFDFTHPCDHEEMRE

SEQ ID NO: 1783 - protein, 15 aa, Artificial sequence
  Synthetic peptide
FDFTHPCDHEEMREM

SEQ ID NO: 1784 - protein, 15 aa, Artificial sequence
  Synthetic peptide
DFTHPCDHEEMREML

SEQ ID NO: 1785 - protein, 15 aa, Artificial sequence
  Synthetic peptide
FTHPCDHEEMREMLT

SEQ ID NO: 1786 - protein, 15 aa, Artificial sequence
  Synthetic peptide
THPCDHEEMREMLTH

SEQ ID NO: 1787 - protein, 15 aa, Artificial sequence
  Synthetic peptide
HPCDHEEMREMLTHR

SEQ ID NO: 1788 - protein, 15 aa, Artificial sequence
  Synthetic peptide
PCDHEEMREMLTHRN

SEQ ID NO: 1789 - protein, 15 aa, Artificial sequence
  Synthetic peptide
CDHEEMREMLTHRNG

SEQ ID NO: 1790 - protein, 15 aa, Artificial sequence
  Synthetic peptide
DHEEMREMLTHRNGL

SEQ ID NO: 1791 - protein, 15 aa, Artificial sequence
  Synthetic peptide
HEEMREMLTHRNGLV

SEQ ID NO: 1792 - protein, 15 aa, Artificial sequence
  Synthetic peptide
EEMREMLTHRNGLVK

SEQ ID NO: 1793 - protein, 15 aa, Artificial sequence
  Synthetic peptide
EMREMLTHRNGLVKK

SEQ ID NO: 1794 - protein, 15 aa, Artificial sequence
  Synthetic peptide
MREMLTHRNGLVKKG

SEQ ID NO: 1795 - protein, 15 aa, Artificial sequence
  Synthetic peptide
REMLTHRNGLVKKGK

SEQ ID NO: 1796 - protein, 15 aa, Artificial sequence
  Synthetic peptide
EMLTHRNGLVKKGKE

SEQ ID NO: 1797 - protein, 15 aa, Artificial sequence
  Synthetic peptide
MLTHRNGLVKKGKEQ

SEQ ID NO: 1798 - protein, 15 aa, Artificial sequence
  Synthetic peptide
LTHRNGLVKKGKEQN

SEQ ID NO: 1799 - protein, 15 aa, Artificial sequence
  Synthetic peptide
THRNGLVKKGKEQNT

SEQ ID NO: 1800 - protein, 15 aa, Artificial sequence
  Synthetic peptide
HRNGLVKKGKEQNTQ

SEQ ID NO: 1801 - protein, 15 aa, Artificial sequence
  Synthetic peptide
RNGLVKKGKEQNTQR

SEQ ID NO: 1802 - protein, 15 aa, Artificial sequence
  Synthetic peptide
NGLVKKGKEQNTQRS

SEQ ID NO: 1803 - protein, 15 aa, Artificial sequence
  Synthetic peptide
GLVKKGKEQNTQRSF

SEQ ID NO: 1804 - protein, 15 aa, Artificial sequence
  Synthetic peptide
LVKKGKEQNTQRSFF

SEQ ID NO: 1805 - protein, 15 aa, Artificial sequence
  Synthetic peptide
VKKGKEQNTQRSFFL

SEQ ID NO: 1806 - protein, 15 aa, Artificial sequence
  Synthetic peptide
KKGKEQNTQRSFFLR

SEQ ID NO: 1807 - protein, 15 aa, Artificial sequence
  Synthetic peptide
KGKEQNTQRSFFLRM

SEQ ID NO: 1808 - protein, 15 aa, Artificial sequence
  Synthetic peptide
GKEQNTQRSFFLRMK

SEQ ID NO: 1809 - protein, 15 aa, Artificial sequence
  Synthetic peptide
KEQNTQRSFFLRMKC

SEQ ID NO: 1810 - protein, 15 aa, Artificial sequence
  Synthetic peptide
EQNTQRSFFLRMKCT

SEQ ID NO: 1811 - protein, 15 aa, Artificial sequence
  Synthetic peptide
QNTQRSFFLRMKCTL

SEQ ID NO: 1812 - protein, 15 aa, Artificial sequence
  Synthetic peptide
NTQRSFFLRMKCTLT

SEQ ID NO: 1813 - protein, 15 aa, Artificial sequence
  Synthetic peptide
TQRSFFLRMKCTLTS

SEQ ID NO: 1814 - protein, 15 aa, Artificial sequence
  Synthetic peptide
QRSFFLRMKCTLTSR

SEQ ID NO: 1815 - protein, 15 aa, Artificial sequence
  Synthetic peptide
RSFFLRMKCTLTSRG

SEQ ID NO: 1816 - protein, 15 aa, Artificial sequence
  Synthetic peptide
SFFLRMKCTLTSRGR

SEQ ID NO: 1817 - protein, 15 aa, Artificial sequence
  Synthetic peptide
FFLRMKCTLTSRGRT

SEQ ID NO: 1818 - protein, 15 aa, Artificial sequence
  Synthetic peptide
FLRMKCTLTSRGRTM

SEQ ID NO: 1819 - protein, 15 aa, Artificial sequence
  Synthetic peptide
LRMKCTLTSRGRTMN

SEQ ID NO: 1820 - protein, 15 aa, Artificial sequence
  Synthetic peptide
RMKCTLTSRGRTMNI

SEQ ID NO: 1821 - protein, 15 aa, Artificial sequence
  Synthetic peptide
MKCTLTSRGRTMNIK

SEQ ID NO: 1822 - protein, 15 aa, Artificial sequence
  Synthetic peptide
KCTLTSRGRTMNIKS

SEQ ID NO: 1823 - protein, 15 aa, Artificial sequence
  Synthetic peptide
CTLTSRGRTMNIKSA

SEQ ID NO: 1824 - protein, 15 aa, Artificial sequence
  Synthetic peptide
TLTSRGRTMNIKSAT

SEQ ID NO: 1825 - protein, 15 aa, Artificial sequence
  Synthetic peptide
LTSRGRTMNIKSATW

SEQ ID NO: 1826 - protein, 15 aa, Artificial sequence
  Synthetic peptide
TSRGRTMNIKSATWK

SEQ ID NO: 1827 - protein, 15 aa, Artificial sequence
  Synthetic peptide
SRGRTMNIKSATWKV

SEQ ID NO: 1828 - protein, 15 aa, Artificial sequence
  Synthetic peptide
RGRTMNIKSATWKVL

SEQ ID NO: 1829 - protein, 15 aa, Artificial sequence
  Synthetic peptide
GRTMNIKSATWKVLH

SEQ ID NO: 1830 - protein, 15 aa, Artificial sequence
  Synthetic peptide
RTMNIKSATWKVLHC

SEQ ID NO: 1831 - protein, 15 aa, Artificial sequence
  Synthetic peptide
TMNIKSATWKVLHCT

SEQ ID NO: 1832 - protein, 15 aa, Artificial sequence
  Synthetic peptide
MNIKSATWKVLHCTG

SEQ ID NO: 1833 - protein, 15 aa, Artificial sequence
  Synthetic peptide
NIKSATWKVLHCTGH

SEQ ID NO: 1834 - protein, 15 aa, Artificial sequence
  Synthetic peptide
IKSATWKVLHCTGHI

SEQ ID NO: 1835 - protein, 15 aa, Artificial sequence
  Synthetic peptide
KSATWKVLHCTGHIH

SEQ ID NO: 1836 - protein, 15 aa, Artificial sequence
  Synthetic peptide
SATWKVLHCTGHIHV

SEQ ID NO: 1837 - protein, 15 aa, Artificial sequence
  Synthetic peptide
ATWKVLHCTGHIHVY

SEQ ID NO: 1838 - protein, 15 aa, Artificial sequence
  Synthetic peptide
TWKVLHCTGHIHVYD

SEQ ID NO: 1839 - protein, 15 aa, Artificial sequence
  Synthetic peptide
WKVLHCTGHIHVYDT

SEQ ID NO: 1840 - protein, 15 aa, Artificial sequence
  Synthetic peptide
KVLHCTGHIHVYDTN

SEQ ID NO: 1841 - protein, 15 aa, Artificial sequence
  Synthetic peptide
VLHCTGHIHVYDTNS

SEQ ID NO: 1842 - protein, 15 aa, Artificial sequence
  Synthetic peptide
LHCTGHIHVYDTNSN

SEQ ID NO: 1843 - protein, 15 aa, Artificial sequence
  Synthetic peptide
HCTGHIHVYDTNSNQ

SEQ ID NO: 1844 - protein, 15 aa, Artificial sequence
  Synthetic peptide
CTGHIHVYDTNSNQP

SEQ ID NO: 1845 - protein, 15 aa, Artificial sequence
  Synthetic peptide
TGHIHVYDTNSNQPQ

SEQ ID NO: 1846 - protein, 15 aa, Artificial sequence
  Synthetic peptide
GHIHVYDTNSNQPQC

SEQ ID NO: 1847 - protein, 15 aa, Artificial sequence
  Synthetic peptide
HIHVYDTNSNQPQCG

SEQ ID NO: 1848 - protein, 15 aa, Artificial sequence
  Synthetic peptide
IHVYDTNSNQPQCGY

SEQ ID NO: 1849 - protein, 15 aa, Artificial sequence
  Synthetic peptide
HVYDTNSNQPQCGYK

SEQ ID NO: 1850 - protein, 15 aa, Artificial sequence
  Synthetic peptide
VYDTNSNQPQCGYKK

SEQ ID NO: 1851 - protein, 15 aa, Artificial sequence
  Synthetic peptide
YDTNSNQPQCGYKKP

SEQ ID NO: 1852 - protein, 15 aa, Artificial sequence
  Synthetic peptide
DTNSNQPQCGYKKPP

SEQ ID NO: 1853 - protein, 15 aa, Artificial sequence
  Synthetic peptide
TNSNQPQCGYKKPPM

SEQ ID NO: 1854 - protein, 15 aa, Artificial sequence
  Synthetic peptide
NSNQPQCGYKKPPMT

SEQ ID NO: 1855 - protein, 15 aa, Artificial sequence
  Synthetic peptide
SNQPQCGYKKPPMTC

SEQ ID NO: 1856 - protein, 15 aa, Artificial sequence
  Synthetic peptide
NQPQCGYKKPPMTCL

SEQ ID NO: 1857 - protein, 15 aa, Artificial sequence
  Synthetic peptide
QPQCGYKKPPMTCLV

SEQ ID NO: 1858 - protein, 15 aa, Artificial sequence
  Synthetic peptide
PQCGYKKPPMTCLVL

SEQ ID NO: 1859 - protein, 15 aa, Artificial sequence
  Synthetic peptide
QCGYKKPPMTCLVLI

SEQ ID NO: 1860 - protein, 15 aa, Artificial sequence
  Synthetic peptide
CGYKKPPMTCLVLIC

SEQ ID NO: 1861 - protein, 15 aa, Artificial sequence
  Synthetic peptide
GYKKPPMTCLVLICE

SEQ ID NO: 1862 - protein, 15 aa, Artificial sequence
  Synthetic peptide
YKKPPMTCLVLICEP

SEQ ID NO: 1863 - protein, 15 aa, Artificial sequence
  Synthetic peptide
KKPPMTCLVLICEPI

SEQ ID NO: 1864 - protein, 15 aa, Artificial sequence
  Synthetic peptide
KPPMTCLVLICEPIP

SEQ ID NO: 1865 - protein, 15 aa, Artificial sequence
  Synthetic peptide
PPMTCLVLICEPIPH

SEQ ID NO: 1866 - protein, 15 aa, Artificial sequence
  Synthetic peptide
PMTCLVLICEPIPHP

SEQ ID NO: 1867 - protein, 15 aa, Artificial sequence
  Synthetic peptide
MTCLVLICEPIPHPS

SEQ ID NO: 1868 - protein, 15 aa, Artificial sequence
  Synthetic peptide
TCLVLICEPIPHPSN

SEQ ID NO: 1869 - protein, 15 aa, Artificial sequence
  Synthetic peptide
CLVLICEPIPHPSNI

SEQ ID NO: 1870 - protein, 15 aa, Artificial sequence
  Synthetic peptide
LVLICEPIPHPSNIE

SEQ ID NO: 1871 - protein, 15 aa, Artificial sequence
  Synthetic peptide
VLICEPIPHPSNIEI

SEQ ID NO: 1872 - protein, 15 aa, Artificial sequence
  Synthetic peptide
LICEPIPHPSNIEIP

SEQ ID NO: 1873 - protein, 15 aa, Artificial sequence
  Synthetic peptide
ICEPIPHPSNIEIPL

SEQ ID NO: 1874 - protein, 15 aa, Artificial sequence
  Synthetic peptide
CEPIPHPSNIEIPLD

SEQ ID NO: 1875 - protein, 15 aa, Artificial sequence
  Synthetic peptide
EPIPHPSNIEIPLDS

SEQ ID NO: 1876 - protein, 15 aa, Artificial sequence
  Synthetic peptide
PIPHPSNIEIPLDSK

SEQ ID NO: 1877 - protein, 15 aa, Artificial sequence
  Synthetic peptide
IPHPSNIEIPLDSKT

SEQ ID NO: 1878 - protein, 15 aa, Artificial sequence
  Synthetic peptide
PHPSNIEIPLDSKTF

SEQ ID NO: 1879 - protein, 15 aa, Artificial sequence
  Synthetic peptide
HPSNIEIPLDSKTFL

SEQ ID NO: 1880 - protein, 15 aa, Artificial sequence
  Synthetic peptide
PSNIEIPLDSKTFLS

SEQ ID NO: 1881 - protein, 15 aa, Artificial sequence
  Synthetic peptide
SNIEIPLDSKTFLSR

SEQ ID NO: 1882 - protein, 15 aa, Artificial sequence
  Synthetic peptide
NIEIPLDSKTFLSRH

SEQ ID NO: 1883 - protein, 15 aa, Artificial sequence
  Synthetic peptide
IEIPLDSKTFLSRHS

SEQ ID NO: 1884 - protein, 15 aa, Artificial sequence
  Synthetic peptide
EIPLDSKTFLSRHSL

SEQ ID NO: 1885 - protein, 15 aa, Artificial sequence
  Synthetic peptide
IPLDSKTFLSRHSLD

SEQ ID NO: 1886 - protein, 15 aa, Artificial sequence
  Synthetic peptide
PLDSKTFLSRHSLDM

SEQ ID NO: 1887 - protein, 15 aa, Artificial sequence
  Synthetic peptide
LDSKTFLSRHSLDMK

SEQ ID NO: 1888 - protein, 15 aa, Artificial sequence
  Synthetic peptide
DSKTFLSRHSLDMKF

SEQ ID NO: 1889 - protein, 15 aa, Artificial sequence
  Synthetic peptide
SKTFLSRHSLDMKFS

SEQ ID NO: 1890 - protein, 15 aa, Artificial sequence
  Synthetic peptide
KTFLSRHSLDMKFSY

SEQ ID NO: 1891 - protein, 15 aa, Artificial sequence
  Synthetic peptide
TFLSRHSLDMKFSYC

SEQ ID NO: 1892 - protein, 15 aa, Artificial sequence
  Synthetic peptide
FLSRHSLDMKFSYCD

SEQ ID NO: 1893 - protein, 15 aa, Artificial sequence
  Synthetic peptide
LSRHSLDMKFSYCDE

SEQ ID NO: 1894 - protein, 15 aa, Artificial sequence
  Synthetic peptide
SRHSLDMKFSYCDER

SEQ ID NO: 1895 - protein, 15 aa, Artificial sequence
  Synthetic peptide
RHSLDMKFSYCDERI

SEQ ID NO: 1896 - protein, 15 aa, Artificial sequence
  Synthetic peptide
HSLDMKFSYCDERIT

SEQ ID NO: 1897 - protein, 15 aa, Artificial sequence
  Synthetic peptide
SLDMKFSYCDERITE

SEQ ID NO: 1898 - protein, 15 aa, Artificial sequence
  Synthetic peptide
LDMKFSYCDERITEL

SEQ ID NO: 1899 - protein, 15 aa, Artificial sequence
  Synthetic peptide
DMKFSYCDERITELM

SEQ ID NO: 1900 - protein, 15 aa, Artificial sequence
  Synthetic peptide
MKFSYCDERITELMG

SEQ ID NO: 1901 - protein, 15 aa, Artificial sequence
  Synthetic peptide
KFSYCDERITELMGY

SEQ ID NO: 1902 - protein, 15 aa, Artificial sequence
  Synthetic peptide
FSYCDERITELMGYE

SEQ ID NO: 1903 - protein, 15 aa, Artificial sequence
  Synthetic peptide
SYCDERITELMGYEP

SEQ ID NO: 1904 - protein, 15 aa, Artificial sequence
  Synthetic peptide
YCDERITELMGYEPE

SEQ ID NO: 1905 - protein, 15 aa, Artificial sequence
  Synthetic peptide
CDERITELMGYEPEE

SEQ ID NO: 1906 - protein, 15 aa, Artificial sequence
  Synthetic peptide
DERITELMGYEPEEL

SEQ ID NO: 1907 - protein, 15 aa, Artificial sequence
  Synthetic peptide
ERITELMGYEPEELL

SEQ ID NO: 1908 - protein, 15 aa, Artificial sequence
  Synthetic peptide
RITELMGYEPEELLG

SEQ ID NO: 1909 - protein, 15 aa, Artificial sequence
  Synthetic peptide
ITELMGYEPEELLGR

SEQ ID NO: 1910 - protein, 15 aa, Artificial sequence
  Synthetic peptide
TELMGYEPEELLGRS

SEQ ID NO: 1911 - protein, 15 aa, Artificial sequence
  Synthetic peptide
ELMGYEPEELLGRSI

SEQ ID NO: 1912 - protein, 15 aa, Artificial sequence
  Synthetic peptide
LMGYEPEELLGRSIY

SEQ ID NO: 1913 - protein, 15 aa, Artificial sequence
  Synthetic peptide
MGYEPEELLGRSIYE

SEQ ID NO: 1914 - protein, 15 aa, Artificial sequence
  Synthetic peptide
GYEPEELLGRSIYEY

SEQ ID NO: 1915 - protein, 15 aa, Artificial sequence
  Synthetic peptide
YEPEELLGRSIYEYY

SEQ ID NO: 1916 - protein, 15 aa, Artificial sequence
  Synthetic peptide
EPEELLGRSIYEYYH

SEQ ID NO: 1917 - protein, 15 aa, Artificial sequence
  Synthetic peptide
PEELLGRSIYEYYHA

SEQ ID NO: 1918 - protein, 15 aa, Artificial sequence
  Synthetic peptide
EELLGRSIYEYYHAL

SEQ ID NO: 1919 - protein, 15 aa, Artificial sequence
  Synthetic peptide
ELLGRSIYEYYHALD

SEQ ID NO: 1920 - protein, 15 aa, Artificial sequence
  Synthetic peptide
LLGRSIYEYYHALDS

SEQ ID NO: 1921 - protein, 15 aa, Artificial sequence
  Synthetic peptide
LGRSIYEYYHALDSD

SEQ ID NO: 1922 - protein, 15 aa, Artificial sequence
  Synthetic peptide
GRSIYEYYHALDSDH

SEQ ID NO: 1923 - protein, 15 aa, Artificial sequence
  Synthetic peptide
RSIYEYYHALDSDHL

SEQ ID NO: 1924 - protein, 15 aa, Artificial sequence
  Synthetic peptide
SIYEYYHALDSDHLT

SEQ ID NO: 1925 - protein, 15 aa, Artificial sequence
  Synthetic peptide
IYEYYHALDSDHLTK

SEQ ID NO: 1926 - protein, 15 aa, Artificial sequence
  Synthetic peptide
YEYYHALDSDHLTKT

SEQ ID NO: 1927 - protein, 15 aa, Artificial sequence
  Synthetic peptide
EYYHALDSDHLTKTH

SEQ ID NO: 1928 - protein, 15 aa, Artificial sequence
  Synthetic peptide
YYHALDSDHLTKTHH

SEQ ID NO: 1929 - protein, 15 aa, Artificial sequence
  Synthetic peptide
YHALDSDHLTKTHHD

SEQ ID NO: 1930 - protein, 15 aa, Artificial sequence
  Synthetic peptide
HALDSDHLTKTHHDM

SEQ ID NO: 1931 - protein, 15 aa, Artificial sequence
  Synthetic peptide
ALDSDHLTKTHHDMF

SEQ ID NO: 1932 - protein, 15 aa, Artificial sequence
  Synthetic peptide
LDSDHLTKTHHDMFT

SEQ ID NO: 1933 - protein, 15 aa, Artificial sequence
  Synthetic peptide
DSDHLTKTHHDMFTK

SEQ ID NO: 1934 - protein, 15 aa, Artificial sequence
  Synthetic peptide
SDHLTKTHHDMFTKG

SEQ ID NO: 1935 - protein, 15 aa, Artificial sequence
  Synthetic peptide
DHLTKTHHDMFTKGQ

SEQ ID NO: 1936 - protein, 15 aa, Artificial sequence
  Synthetic peptide
HLTKTHHDMFTKGQV

SEQ ID NO: 1937 - protein, 15 aa, Artificial sequence
  Synthetic peptide
LTKTHHDMFTKGQVT

SEQ ID NO: 1938 - protein, 15 aa, Artificial sequence
  Synthetic peptide
TKTHHDMFTKGQVTT

SEQ ID NO: 1939 - protein, 15 aa, Artificial sequence
  Synthetic peptide
KTHHDMFTKGQVTTG

SEQ ID NO: 1940 - protein, 15 aa, Artificial sequence
  Synthetic peptide
THHDMFTKGQVTTGQ

SEQ ID NO: 1941 - protein, 15 aa, Artificial sequence
  Synthetic peptide
HHDMFTKGQVTTGQY

SEQ ID NO: 1942 - protein, 15 aa, Artificial sequence
  Synthetic peptide
HDMFTKGQVTTGQYR

SEQ ID NO: 1943 - protein, 15 aa, Artificial sequence
  Synthetic peptide
DMFTKGQVTTGQYRM

SEQ ID NO: 1944 - protein, 15 aa, Artificial sequence
  Synthetic peptide
MFTKGQVTTGQYRML

SEQ ID NO: 1945 - protein, 15 aa, Artificial sequence
  Synthetic peptide
FTKGQVTTGQYRMLA

SEQ ID NO: 1946 - protein, 15 aa, Artificial sequence
  Synthetic peptide
TKGQVTTGQYRMLAK

SEQ ID NO: 1947 - protein, 15 aa, Artificial sequence
  Synthetic peptide
KGQVTTGQYRMLAKR

SEQ ID NO: 1948 - protein, 15 aa, Artificial sequence
  Synthetic peptide
GQVTTGQYRMLAKRG

SEQ ID NO: 1949 - protein, 15 aa, Artificial sequence
  Synthetic peptide
QVTTGQYRMLAKRGG

SEQ ID NO: 1950 - protein, 15 aa, Artificial sequence
  Synthetic peptide
VTTGQYRMLAKRGGY

SEQ ID NO: 1951 - protein, 15 aa, Artificial sequence
  Synthetic peptide
TTGQYRMLAKRGGYV

SEQ ID NO: 1952 - protein, 15 aa, Artificial sequence
  Synthetic peptide
TGQYRMLAKRGGYVW

SEQ ID NO: 1953 - protein, 15 aa, Artificial sequence
  Synthetic peptide
GQYRMLAKRGGYVWV

SEQ ID NO: 1954 - protein, 15 aa, Artificial sequence
  Synthetic peptide
QYRMLAKRGGYVWVE

SEQ ID NO: 1955 - protein, 15 aa, Artificial sequence
  Synthetic peptide
YRMLAKRGGYVWVET

SEQ ID NO: 1956 - protein, 15 aa, Artificial sequence
  Synthetic peptide
RMLAKRGGYVWVETQ

SEQ ID NO: 1957 - protein, 15 aa, Artificial sequence
  Synthetic peptide
MLAKRGGYVWVETQA

SEQ ID NO: 1958 - protein, 15 aa, Artificial sequence
  Synthetic peptide
LAKRGGYVWVETQAT

SEQ ID NO: 1959 - protein, 15 aa, Artificial sequence
  Synthetic peptide
AKRGGYVWVETQATV

SEQ ID NO: 1960 - protein, 15 aa, Artificial sequence
  Synthetic peptide
KRGGYVWVETQATVI

SEQ ID NO: 1961 - protein, 15 aa, Artificial sequence
  Synthetic peptide
RGGYVWVETQATVIY

SEQ ID NO: 1962 - protein, 15 aa, Artificial sequence
  Synthetic peptide
GGYVWVETQATVIYN

SEQ ID NO: 1963 - protein, 15 aa, Artificial sequence
  Synthetic peptide
GYVWVETQATVIYNT

SEQ ID NO: 1964 - protein, 15 aa, Artificial sequence
  Synthetic peptide
YVWVETQATVIYNTK

SEQ ID NO: 1965 - protein, 15 aa, Artificial sequence
  Synthetic peptide
VWVETQATVIYNTKN

SEQ ID NO: 1966 - protein, 15 aa, Artificial sequence
  Synthetic peptide
WVETQATVIYNTKNS

SEQ ID NO: 1967 - protein, 15 aa, Artificial sequence
  Synthetic peptide
VETQATVIYNTKNSQ

SEQ ID NO: 1968 - protein, 15 aa, Artificial sequence
  Synthetic peptide
ETQATVIYNTKNSQP

SEQ ID NO: 1969 - protein, 15 aa, Artificial sequence
  Synthetic peptide
TQATVIYNTKNSQPQ

SEQ ID NO: 1970 - protein, 15 aa, Artificial sequence
  Synthetic peptide
QATVIYNTKNSQPQC

SEQ ID NO: 1971 - protein, 15 aa, Artificial sequence
  Synthetic peptide
ATVIYNTKNSQPQCI

SEQ ID NO: 1972 - protein, 15 aa, Artificial sequence
  Synthetic peptide
TVIYNTKNSQPQCIV

SEQ ID NO: 1973 - protein, 15 aa, Artificial sequence
  Synthetic peptide
VIYNTKNSQPQCIVC

SEQ ID NO: 1974 - protein, 15 aa, Artificial sequence
  Synthetic peptide
IYNTKNSQPQCIVCV

SEQ ID NO: 1975 - protein, 15 aa, Artificial sequence
  Synthetic peptide
YNTKNSQPQCIVCVN

SEQ ID NO: 1976 - protein, 15 aa, Artificial sequence
  Synthetic peptide
NTKNSQPQCIVCVNY

SEQ ID NO: 1977 - protein, 15 aa, Artificial sequence
  Synthetic peptide
TKNSQPQCIVCVNYV

SEQ ID NO: 1978 - protein, 15 aa, Artificial sequence
  Synthetic peptide
KNSQPQCIVCVNYVV

SEQ ID NO: 1979 - protein, 15 aa, Artificial sequence
  Synthetic peptide
NSQPQCIVCVNYVVS

SEQ ID NO: 1980 - protein, 15 aa, Artificial sequence
  Synthetic peptide
SQPQCIVCVNYVVSG

SEQ ID NO: 1981 - protein, 15 aa, Artificial sequence
  Synthetic peptide
QPQCIVCVNYVVSGI

SEQ ID NO: 1982 - protein, 15 aa, Artificial sequence
  Synthetic peptide
PQCIVCVNYVVSGII

SEQ ID NO: 1983 - protein, 15 aa, Artificial sequence
  Synthetic peptide
QCIVCVNYVVSGIIQ

SEQ ID NO: 1984 - protein, 15 aa, Artificial sequence
  Synthetic peptide
CIVCVNYVVSGIIQH

SEQ ID NO: 1985 - protein, 15 aa, Artificial sequence
  Synthetic peptide
IVCVNYVVSGIIQHD

SEQ ID NO: 1986 - protein, 15 aa, Artificial sequence
  Synthetic peptide
VCVNYVVSGIIQHDL

SEQ ID NO: 1987 - protein, 15 aa, Artificial sequence
  Synthetic peptide
CVNYVVSGIIQHDLI

SEQ ID NO: 1988 - protein, 15 aa, Artificial sequence
  Synthetic peptide
VNYVVSGIIQHDLIF

SEQ ID NO: 1989 - protein, 15 aa, Artificial sequence
  Synthetic peptide
NYVVSGIIQHDLIFS

SEQ ID NO: 1990 - protein, 15 aa, Artificial sequence
  Synthetic peptide
YVVSGIIQHDLIFSL

SEQ ID NO: 1991 - protein, 15 aa, Artificial sequence
  Synthetic peptide
VVSGIIQHDLIFSLQ

SEQ ID NO: 1992 - protein, 15 aa, Artificial sequence
  Synthetic peptide
VSGIIQHDLIFSLQQ

SEQ ID NO: 1993 - protein, 15 aa, Artificial sequence
  Synthetic peptide
SGIIQHDLIFSLQQT

SEQ ID NO: 1994 - protein, 15 aa, Artificial sequence
  Synthetic peptide
GIIQHDLIFSLQQTE

SEQ ID NO: 1995 - protein, 15 aa, Artificial sequence
  Synthetic peptide
IIQHDLIFSLQQTEC

SEQ ID NO: 1996 - protein, 15 aa, Artificial sequence
  Synthetic peptide
IQHDLIFSLQQTECV

SEQ ID NO: 1997 - protein, 15 aa, Artificial sequence
  Synthetic peptide
QHDLIFSLQQTECVL

SEQ ID NO: 1998 - protein, 15 aa, Artificial sequence
  Synthetic peptide
HDLIFSLQQTECVLK

SEQ ID NO: 1999 - protein, 15 aa, Artificial sequence
  Synthetic peptide
DLIFSLQQTECVLKP

SEQ ID NO: 2000 - protein, 15 aa, Artificial sequence
  Synthetic peptide
LIFSLQQTECVLKPV

SEQ ID NO: 2001 - protein, 15 aa, Artificial sequence
  Synthetic peptide
IFSLQQTECVLKPVE

SEQ ID NO: 2002 - protein, 15 aa, Artificial sequence
  Synthetic peptide
FSLQQTECVLKPVES

SEQ ID NO: 2003 - protein, 15 aa, Artificial sequence
  Synthetic peptide
SLQQTECVLKPVESS

SEQ ID NO: 2004 - protein, 15 aa, Artificial sequence
  Synthetic peptide
LQQTECVLKPVESSD

SEQ ID NO: 2005 - protein, 15 aa, Artificial sequence
  Synthetic peptide
QQTECVLKPVESSDM

SEQ ID NO: 2006 - protein, 15 aa, Artificial sequence
  Synthetic peptide
QTECVLKPVESSDMK

SEQ ID NO: 2007 - protein, 15 aa, Artificial sequence
  Synthetic peptide
TECVLKPVESSDMKM

SEQ ID NO: 2008 - protein, 15 aa, Artificial sequence
  Synthetic peptide
ECVLKPVESSDMKMT

SEQ ID NO: 2009 - protein, 15 aa, Artificial sequence
  Synthetic peptide
CVLKPVESSDMKMTQ

SEQ ID NO: 2010 - protein, 15 aa, Artificial sequence
  Synthetic peptide
VLKPVESSDMKMTQL

SEQ ID NO: 2011 - protein, 15 aa, Artificial sequence
  Synthetic peptide
LKPVESSDMKMTQLF

SEQ ID NO: 2012 - protein, 15 aa, Artificial sequence
  Synthetic peptide
KPVESSDMKMTQLFT

SEQ ID NO: 2013 - protein, 15 aa, Artificial sequence
  Synthetic peptide
PVESSDMKMTQLFTK

SEQ ID NO: 2014 - protein, 15 aa, Artificial sequence
  Synthetic peptide
VESSDMKMTQLFTKV

SEQ ID NO: 2015 - protein, 15 aa, Artificial sequence
  Synthetic peptide
ESSDMKMTQLFTKVE

SEQ ID NO: 2016 - protein, 15 aa, Artificial sequence
  Synthetic peptide
SSDMKMTQLFTKVES

SEQ ID NO: 2017 - protein, 15 aa, Artificial sequence
  Synthetic peptide
SDMKMTQLFTKVESE

SEQ ID NO: 2018 - protein, 15 aa, Artificial sequence
  Synthetic peptide
DMKMTQLFTKVESED

SEQ ID NO: 2019 - protein, 15 aa, Artificial sequence
  Synthetic peptide
MKMTQLFTKVESEDT

SEQ ID NO: 2020 - protein, 15 aa, Artificial sequence
  Synthetic peptide
KMTQLFTKVESEDTS

SEQ ID NO: 2021 - protein, 15 aa, Artificial sequence
  Synthetic peptide
MTQLFTKVESEDTSS

SEQ ID NO: 2022 - protein, 15 aa, Artificial sequence
  Synthetic peptide
TQLFTKVESEDTSSL

SEQ ID NO: 2023 - protein, 15 aa, Artificial sequence
  Synthetic peptide
QLFTKVESEDTSSLF

SEQ ID NO: 2024 - protein, 15 aa, Artificial sequence
  Synthetic peptide
LFTKVESEDTSSLFD

SEQ ID NO: 2025 - protein, 15 aa, Artificial sequence
  Synthetic peptide
FTKVESEDTSSLFDK

SEQ ID NO: 2026 - protein, 15 aa, Artificial sequence
  Synthetic peptide
TKVESEDTSSLFDKL

SEQ ID NO: 2027 - protein, 15 aa, Artificial sequence
  Synthetic peptide
KVESEDTSSLFDKLK

SEQ ID NO: 2028 - protein, 15 aa, Artificial sequence
  Synthetic peptide
VESEDTSSLFDKLKK

SEQ ID NO: 2029 - protein, 15 aa, Artificial sequence
  Synthetic peptide
ESEDTSSLFDKLKKE

SEQ ID NO: 2030 - protein, 15 aa, Artificial sequence
  Synthetic peptide
SEDTSSLFDKLKKEP

SEQ ID NO: 2031 - protein, 15 aa, Artificial sequence
  Synthetic peptide
EDTSSLFDKLKKEPD

SEQ ID NO: 2032 - protein, 15 aa, Artificial sequence
  Synthetic peptide
DTSSLFDKLKKEPDA

SEQ ID NO: 2033 - protein, 15 aa, Artificial sequence
  Synthetic peptide
TSSLFDKLKKEPDAL

SEQ ID NO: 2034 - protein, 15 aa, Artificial sequence
  Synthetic peptide
SSLFDKLKKEPDALT

SEQ ID NO: 2035 - protein, 15 aa, Artificial sequence
  Synthetic peptide
SLFDKLKKEPDALTL

SEQ ID NO: 2036 - protein, 15 aa, Artificial sequence
  Synthetic peptide
LFDKLKKEPDALTLL

SEQ ID NO: 2037 - protein, 15 aa, Artificial sequence
  Synthetic peptide
FDKLKKEPDALTLLA

SEQ ID NO: 2038 - protein, 15 aa, Artificial sequence
  Synthetic peptide
DKLKKEPDALTLLAP

SEQ ID NO: 2039 - protein, 15 aa, Artificial sequence
  Synthetic peptide
KLKKEPDALTLLAPA

SEQ ID NO: 2040 - protein, 15 aa, Artificial sequence
  Synthetic peptide
LKKEPDALTLLAPAA

SEQ ID NO: 2041 - protein, 15 aa, Artificial sequence
  Synthetic peptide
KKEPDALTLLAPAAG

SEQ ID NO: 2042 - protein, 15 aa, Artificial sequence
  Synthetic peptide
KEPDALTLLAPAAGD

SEQ ID NO: 2043 - protein, 15 aa, Artificial sequence
  Synthetic peptide
EPDALTLLAPAAGDT

SEQ ID NO: 2044 - protein, 15 aa, Artificial sequence
  Synthetic peptide
PDALTLLAPAAGDTI

SEQ ID NO: 2045 - protein, 15 aa, Artificial sequence
  Synthetic peptide
DALTLLAPAAGDTII

SEQ ID NO: 2046 - protein, 15 aa, Artificial sequence
  Synthetic peptide
ALTLLAPAAGDTIIS

SEQ ID NO: 2047 - protein, 15 aa, Artificial sequence
  Synthetic peptide
LTLLAPAAGDTIISL

SEQ ID NO: 2048 - protein, 15 aa, Artificial sequence
  Synthetic peptide
TLLAPAAGDTIISLD

SEQ ID NO: 2049 - protein, 15 aa, Artificial sequence
  Synthetic peptide
LLAPAAGDTIISLDF

SEQ ID NO: 2050 - protein, 15 aa, Artificial sequence
  Synthetic peptide
LAPAAGDTIISLDFG

SEQ ID NO: 2051 - protein, 15 aa, Artificial sequence
  Synthetic peptide
APAAGDTIISLDFGS

SEQ ID NO: 2052 - protein, 15 aa, Artificial sequence
  Synthetic peptide
PAAGDTIISLDFGSN

SEQ ID NO: 2053 - protein, 15 aa, Artificial sequence
  Synthetic peptide
AAGDTIISLDFGSND

SEQ ID NO: 2054 - protein, 15 aa, Artificial sequence
  Synthetic peptide
AGDTIISLDFGSNDT

SEQ ID NO: 2055 - protein, 15 aa, Artificial sequence
  Synthetic peptide
GDTIISLDFGSNDTE

SEQ ID NO: 2056 - protein, 15 aa, Artificial sequence
  Synthetic peptide
DTIISLDFGSNDTET

SEQ ID NO: 2057 - protein, 15 aa, Artificial sequence
  Synthetic peptide
TIISLDFGSNDTETD

SEQ ID NO: 2058 - protein, 15 aa, Artificial sequence
  Synthetic peptide
IISLDFGSNDTETDD

SEQ ID NO: 2059 - protein, 15 aa, Artificial sequence
  Synthetic peptide
ISLDFGSNDTETDDQ

SEQ ID NO: 2060 - protein, 15 aa, Artificial sequence
  Synthetic peptide
SLDFGSNDTETDDQQ

SEQ ID NO: 2061 - protein, 15 aa, Artificial sequence
  Synthetic peptide
LDFGSNDTETDDQQL

SEQ ID NO: 2062 - protein, 15 aa, Artificial sequence
  Synthetic peptide
DFGSNDTETDDQQLE

SEQ ID NO: 2063 - protein, 15 aa, Artificial sequence
  Synthetic peptide
FGSNDTETDDQQLEE

SEQ ID NO: 2064 - protein, 15 aa, Artificial sequence
  Synthetic peptide
GSNDTETDDQQLEEV

SEQ ID NO: 2065 - protein, 15 aa, Artificial sequence
  Synthetic peptide
SNDTETDDQQLEEVP

SEQ ID NO: 2066 - protein, 15 aa, Artificial sequence
  Synthetic peptide
NDTETDDQQLEEVPL

SEQ ID NO: 2067 - protein, 15 aa, Artificial sequence
  Synthetic peptide
DTETDDQQLEEVPLY

SEQ ID NO: 2068 - protein, 15 aa, Artificial sequence
  Synthetic peptide
TETDDQQLEEVPLYN

SEQ ID NO: 2069 - protein, 15 aa, Artificial sequence
  Synthetic peptide
ETDDQQLEEVPLYND

SEQ ID NO: 2070 - protein, 15 aa, Artificial sequence
  Synthetic peptide
TDDQQLEEVPLYNDV

SEQ ID NO: 2071 - protein, 15 aa, Artificial sequence
  Synthetic peptide
DDQQLEEVPLYNDVM

SEQ ID NO: 2072 - protein, 15 aa, Artificial sequence
  Synthetic peptide
DQQLEEVPLYNDVML

SEQ ID NO: 2073 - protein, 15 aa, Artificial sequence
  Synthetic peptide
QQLEEVPLYNDVMLP

SEQ ID NO: 2074 - protein, 15 aa, Artificial sequence
  Synthetic peptide
QLEEVPLYNDVMLPS

SEQ ID NO: 2075 - protein, 15 aa, Artificial sequence
  Synthetic peptide
LEEVPLYNDVMLPSP

SEQ ID NO: 2076 - protein, 15 aa, Artificial sequence
  Synthetic peptide
EEVPLYNDVMLPSPN

SEQ ID NO: 2077 - protein, 15 aa, Artificial sequence
  Synthetic peptide
EVPLYNDVMLPSPNE

SEQ ID NO: 2078 - protein, 15 aa, Artificial sequence
  Synthetic peptide
VPLYNDVMLPSPNEK

SEQ ID NO: 2079 - protein, 15 aa, Artificial sequence
  Synthetic peptide
PLYNDVMLPSPNEKL

SEQ ID NO: 2080 - protein, 15 aa, Artificial sequence
  Synthetic peptide
LYNDVMLPSPNEKLQ

SEQ ID NO: 2081 - protein, 15 aa, Artificial sequence
  Synthetic peptide
YNDVMLPSPNEKLQN

SEQ ID NO: 2082 - protein, 15 aa, Artificial sequence
  Synthetic peptide
NDVMLPSPNEKLQNI

SEQ ID NO: 2083 - protein, 15 aa, Artificial sequence
  Synthetic peptide
DVMLPSPNEKLQNIN

SEQ ID NO: 2084 - protein, 15 aa, Artificial sequence
  Synthetic peptide
VMLPSPNEKLQNINL

SEQ ID NO: 2085 - protein, 15 aa, Artificial sequence
  Synthetic peptide
MLPSPNEKLQNINLA

SEQ ID NO: 2086 - protein, 15 aa, Artificial sequence
  Synthetic peptide
LPSPNEKLQNINLAM

SEQ ID NO: 2087 - protein, 15 aa, Artificial sequence
  Synthetic peptide
PSPNEKLQNINLAMS

SEQ ID NO: 2088 - protein, 15 aa, Artificial sequence
  Synthetic peptide
SPNEKLQNINLAMSP

SEQ ID NO: 2089 - protein, 15 aa, Artificial sequence
  Synthetic peptide
PNEKLQNINLAMSPL

SEQ ID NO: 2090 - protein, 15 aa, Artificial sequence
  Synthetic peptide
NEKLQNINLAMSPLP

SEQ ID NO: 2091 - protein, 15 aa, Artificial sequence
  Synthetic peptide
EKLQNINLAMSPLPT

SEQ ID NO: 2092 - protein, 15 aa, Artificial sequence
  Synthetic peptide
KLQNINLAMSPLPTA

SEQ ID NO: 2093 - protein, 15 aa, Artificial sequence
  Synthetic peptide
LQNINLAMSPLPTAE

SEQ ID NO: 2094 - protein, 15 aa, Artificial sequence
  Synthetic peptide
QNINLAMSPLPTAET

SEQ ID NO: 2095 - protein, 15 aa, Artificial sequence
  Synthetic peptide
NINLAMSPLPTAETP

SEQ ID NO: 2096 - protein, 15 aa, Artificial sequence
  Synthetic peptide
INLAMSPLPTAETPK

SEQ ID NO: 2097 - protein, 15 aa, Artificial sequence
  Synthetic peptide
NLAMSPLPTAETPKP

SEQ ID NO: 2098 - protein, 15 aa, Artificial sequence
  Synthetic peptide
LAMSPLPTAETPKPL

SEQ ID NO: 2099 - protein, 15 aa, Artificial sequence
  Synthetic peptide
AMSPLPTAETPKPLR

SEQ ID NO: 2100 - protein, 15 aa, Artificial sequence
  Synthetic peptide
MSPLPTAETPKPLRS

SEQ ID NO: 2101 - protein, 15 aa, Artificial sequence
  Synthetic peptide
SPLPTAETPKPLRSS

SEQ ID NO: 2102 - protein, 15 aa, Artificial sequence
  Synthetic peptide
PLPTAETPKPLRSSA

SEQ ID NO: 2103 - protein, 15 aa, Artificial sequence
  Synthetic peptide
LPTAETPKPLRSSAD

SEQ ID NO: 2104 - protein, 15 aa, Artificial sequence
  Synthetic peptide
PTAETPKPLRSSADP

SEQ ID NO: 2105 - protein, 15 aa, Artificial sequence
  Synthetic peptide
TAETPKPLRSSADPA

SEQ ID NO: 2106 - protein, 15 aa, Artificial sequence
  Synthetic peptide
AETPKPLRSSADPAL

SEQ ID NO: 2107 - protein, 15 aa, Artificial sequence
  Synthetic peptide
ETPKPLRSSADPALN

SEQ ID NO: 2108 - protein, 15 aa, Artificial sequence
  Synthetic peptide
TPKPLRSSADPALNQ

SEQ ID NO: 2109 - protein, 15 aa, Artificial sequence
  Synthetic peptide
PKPLRSSADPALNQE

SEQ ID NO: 2110 - protein, 15 aa, Artificial sequence
  Synthetic peptide
KPLRSSADPALNQEV

SEQ ID NO: 2111 - protein, 15 aa, Artificial sequence
  Synthetic peptide
PLRSSADPALNQEVA

SEQ ID NO: 2112 - protein, 15 aa, Artificial sequence
  Synthetic peptide
LRSSADPALNQEVAL

SEQ ID NO: 2113 - protein, 15 aa, Artificial sequence
  Synthetic peptide
RSSADPALNQEVALK

SEQ ID NO: 2114 - protein, 15 aa, Artificial sequence
  Synthetic peptide
SSADPALNQEVALKL

SEQ ID NO: 2115 - protein, 15 aa, Artificial sequence
  Synthetic peptide
SADPALNQEVALKLE

SEQ ID NO: 2116 - protein, 15 aa, Artificial sequence
  Synthetic peptide
ADPALNQEVALKLEP

SEQ ID NO: 2117 - protein, 15 aa, Artificial sequence
  Synthetic peptide
DPALNQEVALKLEPN

SEQ ID NO: 2118 - protein, 15 aa, Artificial sequence
  Synthetic peptide
PALNQEVALKLEPNP

SEQ ID NO: 2119 - protein, 15 aa, Artificial sequence
  Synthetic peptide
ALNQEVALKLEPNPE

SEQ ID NO: 2120 - protein, 15 aa, Artificial sequence
  Synthetic peptide
LNQEVALKLEPNPES

SEQ ID NO: 2121 - protein, 15 aa, Artificial sequence
  Synthetic peptide
NQEVALKLEPNPESL

SEQ ID NO: 2122 - protein, 15 aa, Artificial sequence
  Synthetic peptide
QEVALKLEPNPESLE

SEQ ID NO: 2123 - protein, 15 aa, Artificial sequence
  Synthetic peptide
EVALKLEPNPESLEL

SEQ ID NO: 2124 - protein, 15 aa, Artificial sequence
  Synthetic peptide
VALKLEPNPESLELS

SEQ ID NO: 2125 - protein, 15 aa, Artificial sequence
  Synthetic peptide
ALKLEPNPESLELSF

SEQ ID NO: 2126 - protein, 15 aa, Artificial sequence
  Synthetic peptide
LKLEPNPESLELSFT

SEQ ID NO: 2127 - protein, 15 aa, Artificial sequence
  Synthetic peptide
KLEPNPESLELSFTM

SEQ ID NO: 2128 - protein, 15 aa, Artificial sequence
  Synthetic peptide
LEPNPESLELSFTMP

SEQ ID NO: 2129 - protein, 15 aa, Artificial sequence
  Synthetic peptide
EPNPESLELSFTMPQ

SEQ ID NO: 2130 - protein, 15 aa, Artificial sequence
  Synthetic peptide
PNPESLELSFTMPQI

SEQ ID NO: 2131 - protein, 15 aa, Artificial sequence
  Synthetic peptide
NPESLELSFTMPQIQ

SEQ ID NO: 2132 - protein, 15 aa, Artificial sequence
  Synthetic peptide
PESLELSFTMPQIQD

SEQ ID NO: 2133 - protein, 15 aa, Artificial sequence
  Synthetic peptide
ESLELSFTMPQIQDQ

SEQ ID NO: 2134 - protein, 15 aa, Artificial sequence
  Synthetic peptide
SLELSFTMPQIQDQT

SEQ ID NO: 2135 - protein, 15 aa, Artificial sequence
  Synthetic peptide
LELSFTMPQIQDQTP

SEQ ID NO: 2136 - protein, 15 aa, Artificial sequence
  Synthetic peptide
ELSFTMPQIQDQTPS

SEQ ID NO: 2137 - protein, 15 aa, Artificial sequence
  Synthetic peptide
LSFTMPQIQDQTPSP

SEQ ID NO: 2138 - protein, 15 aa, Artificial sequence
  Synthetic peptide
SFTMPQIQDQTPSPS

SEQ ID NO: 2139 - protein, 15 aa, Artificial sequence
  Synthetic peptide
FTMPQIQDQTPSPSD

SEQ ID NO: 2140 - protein, 15 aa, Artificial sequence
  Synthetic peptide
TMPQIQDQTPSPSDG

SEQ ID NO: 2141 - protein, 15 aa, Artificial sequence
  Synthetic peptide
MPQIQDQTPSPSDGS

SEQ ID NO: 2142 - protein, 15 aa, Artificial sequence
  Synthetic peptide
PQIQDQTPSPSDGST

SEQ ID NO: 2143 - protein, 15 aa, Artificial sequence
  Synthetic peptide
QIQDQTPSPSDGSTR

SEQ ID NO: 2144 - protein, 15 aa, Artificial sequence
  Synthetic peptide
IQDQTPSPSDGSTRQ

SEQ ID NO: 2145 - protein, 15 aa, Artificial sequence
  Synthetic peptide
QDQTPSPSDGSTRQS

SEQ ID NO: 2146 - protein, 15 aa, Artificial sequence
  Synthetic peptide
DQTPSPSDGSTRQSS

SEQ ID NO: 2147 - protein, 15 aa, Artificial sequence
  Synthetic peptide
QTPSPSDGSTRQSSP

SEQ ID NO: 2148 - protein, 15 aa, Artificial sequence
  Synthetic peptide
TPSPSDGSTRQSSPE

SEQ ID NO: 2149 - protein, 15 aa, Artificial sequence
  Synthetic peptide
PSPSDGSTRQSSPEP

SEQ ID NO: 2150 - protein, 15 aa, Artificial sequence
  Synthetic peptide
SPSDGSTRQSSPEPN

SEQ ID NO: 2151 - protein, 15 aa, Artificial sequence
  Synthetic peptide
PSDGSTRQSSPEPNS

SEQ ID NO: 2152 - protein, 15 aa, Artificial sequence
  Synthetic peptide
SDGSTRQSSPEPNSP

SEQ ID NO: 2153 - protein, 15 aa, Artificial sequence
  Synthetic peptide
DGSTRQSSPEPNSPS

SEQ ID NO: 2154 - protein, 15 aa, Artificial sequence
  Synthetic peptide
GSTRQSSPEPNSPSE

SEQ ID NO: 2155 - protein, 15 aa, Artificial sequence
  Synthetic peptide
STRQSSPEPNSPSEY

SEQ ID NO: 2156 - protein, 15 aa, Artificial sequence
  Synthetic peptide
TRQSSPEPNSPSEYC

SEQ ID NO: 2157 - protein, 15 aa, Artificial sequence
  Synthetic peptide
RQSSPEPNSPSEYCF

SEQ ID NO: 2158 - protein, 15 aa, Artificial sequence
  Synthetic peptide
QSSPEPNSPSEYCFY

SEQ ID NO: 2159 - protein, 15 aa, Artificial sequence
  Synthetic peptide
SSPEPNSPSEYCFYV

SEQ ID NO: 2160 - protein, 15 aa, Artificial sequence
  Synthetic peptide
SPEPNSPSEYCFYVD

SEQ ID NO: 2161 - protein, 15 aa, Artificial sequence
  Synthetic peptide
PEPNSPSEYCFYVDS

SEQ ID NO: 2162 - protein, 15 aa, Artificial sequence
  Synthetic peptide
EPNSPSEYCFYVDSD

SEQ ID NO: 2163 - protein, 15 aa, Artificial sequence
  Synthetic peptide
PNSPSEYCFYVDSDM

SEQ ID NO: 2164 - protein, 15 aa, Artificial sequence
  Synthetic peptide
NSPSEYCFYVDSDMV

SEQ ID NO: 2165 - protein, 15 aa, Artificial sequence
  Synthetic peptide
SPSEYCFYVDSDMVN

SEQ ID NO: 2166 - protein, 15 aa, Artificial sequence
  Synthetic peptide
PSEYCFYVDSDMVNE

SEQ ID NO: 2167 - protein, 15 aa, Artificial sequence
  Synthetic peptide
SEYCFYVDSDMVNEF

SEQ ID NO: 2168 - protein, 15 aa, Artificial sequence
  Synthetic peptide
EYCFYVDSDMVNEFK

SEQ ID NO: 2169 - protein, 15 aa, Artificial sequence
  Synthetic peptide
YCFYVDSDMVNEFKL

SEQ ID NO: 2170 - protein, 15 aa, Artificial sequence
  Synthetic peptide
CFYVDSDMVNEFKLE

SEQ ID NO: 2171 - protein, 15 aa, Artificial sequence
  Synthetic peptide
FYVDSDMVNEFKLEL

SEQ ID NO: 2172 - protein, 15 aa, Artificial sequence
  Synthetic peptide
YVDSDMVNEFKLELV

SEQ ID NO: 2173 - protein, 15 aa, Artificial sequence
  Synthetic peptide
VDSDMVNEFKLELVE

SEQ ID NO: 2174 - protein, 15 aa, Artificial sequence
  Synthetic peptide
DSDMVNEFKLELVEK

SEQ ID NO: 2175 - protein, 15 aa, Artificial sequence
  Synthetic peptide
SDMVNEFKLELVEKL

SEQ ID NO: 2176 - protein, 15 aa, Artificial sequence
  Synthetic peptide
DMVNEFKLELVEKLF

SEQ ID NO: 2177 - protein, 15 aa, Artificial sequence
  Synthetic peptide
MVNEFKLELVEKLFA

SEQ ID NO: 2178 - protein, 15 aa, Artificial sequence
  Synthetic peptide
VNEFKLELVEKLFAE

SEQ ID NO: 2179 - protein, 15 aa, Artificial sequence
  Synthetic peptide
NEFKLELVEKLFAED

SEQ ID NO: 2180 - protein, 15 aa, Artificial sequence
  Synthetic peptide
EFKLELVEKLFAEDT

SEQ ID NO: 2181 - protein, 15 aa, Artificial sequence
  Synthetic peptide
FKLELVEKLFAEDTE

SEQ ID NO: 2182 - protein, 15 aa, Artificial sequence
  Synthetic peptide
KLELVEKLFAEDTEA

SEQ ID NO: 2183 - protein, 15 aa, Artificial sequence
  Synthetic peptide
LELVEKLFAEDTEAK

SEQ ID NO: 2184 - protein, 15 aa, Artificial sequence
  Synthetic peptide
ELVEKLFAEDTEAKN

SEQ ID NO: 2185 - protein, 15 aa, Artificial sequence
  Synthetic peptide
LVEKLFAEDTEAKNP

SEQ ID NO: 2186 - protein, 15 aa, Artificial sequence
  Synthetic peptide
VEKLFAEDTEAKNPF

SEQ ID NO: 2187 - protein, 15 aa, Artificial sequence
  Synthetic peptide
EKLFAEDTEAKNPFS

SEQ ID NO: 2188 - protein, 15 aa, Artificial sequence
  Synthetic peptide
KLFAEDTEAKNPFST

SEQ ID NO: 2189 - protein, 15 aa, Artificial sequence
  Synthetic peptide
LFAEDTEAKNPFSTQ

SEQ ID NO: 2190 - protein, 15 aa, Artificial sequence
  Synthetic peptide
FAEDTEAKNPFSTQD

SEQ ID NO: 2191 - protein, 15 aa, Artificial sequence
  Synthetic peptide
AEDTEAKNPFSTQDT

SEQ ID NO: 2192 - protein, 15 aa, Artificial sequence
  Synthetic peptide
EDTEAKNPFSTQDTD

SEQ ID NO: 2193 - protein, 15 aa, Artificial sequence
  Synthetic peptide
DTEAKNPFSTQDTDL

SEQ ID NO: 2194 - protein, 15 aa, Artificial sequence
  Synthetic peptide
TEAKNPFSTQDTDLD

SEQ ID NO: 2195 - protein, 15 aa, Artificial sequence
  Synthetic peptide
EAKNPFSTQDTDLDL

SEQ ID NO: 2196 - protein, 15 aa, Artificial sequence
  Synthetic peptide
AKNPFSTQDTDLDLE

SEQ ID NO: 2197 - protein, 15 aa, Artificial sequence
  Synthetic peptide
KNPFSTQDTDLDLEM

SEQ ID NO: 2198 - protein, 15 aa, Artificial sequence
  Synthetic peptide
NPFSTQDTDLDLEML

SEQ ID NO: 2199 - protein, 15 aa, Artificial sequence
  Synthetic peptide
PFSTQDTDLDLEMLA

SEQ ID NO: 2200 - protein, 15 aa, Artificial sequence
  Synthetic peptide
FSTQDTDLDLEMLAP

SEQ ID NO: 2201 - protein, 15 aa, Artificial sequence
  Synthetic peptide
STQDTDLDLEMLAPY

SEQ ID NO: 2202 - protein, 15 aa, Artificial sequence
  Synthetic peptide
TQDTDLDLEMLAPYI

SEQ ID NO: 2203 - protein, 15 aa, Artificial sequence
  Synthetic peptide
QDTDLDLEMLAPYIP

SEQ ID NO: 2204 - protein, 15 aa, Artificial sequence
  Synthetic peptide
DTDLDLEMLAPYIPM

SEQ ID NO: 2205 - protein, 15 aa, Artificial sequence
  Synthetic peptide
TDLDLEMLAPYIPMD

SEQ ID NO: 2206 - protein, 15 aa, Artificial sequence
  Synthetic peptide
DLDLEMLAPYIPMDD

SEQ ID NO: 2207 - protein, 15 aa, Artificial sequence
  Synthetic peptide
LDLEMLAPYIPMDDD

SEQ ID NO: 2208 - protein, 15 aa, Artificial sequence
  Synthetic peptide
DLEMLAPYIPMDDDF

SEQ ID NO: 2209 - protein, 15 aa, Artificial sequence
  Synthetic peptide
LEMLAPYIPMDDDFQ

SEQ ID NO: 2210 - protein, 15 aa, Artificial sequence
  Synthetic peptide
EMLAPYIPMDDDFQL

SEQ ID NO: 2211 - protein, 15 aa, Artificial sequence
  Synthetic peptide
MLAPYIPMDDDFQLR

SEQ ID NO: 2212 - protein, 15 aa, Artificial sequence
  Synthetic peptide
LAPYIPMDDDFQLRS

SEQ ID NO: 2213 - protein, 15 aa, Artificial sequence
  Synthetic peptide
APYIPMDDDFQLRSF

SEQ ID NO: 2214 - protein, 15 aa, Artificial sequence
  Synthetic peptide
PYIPMDDDFQLRSFD

SEQ ID NO: 2215 - protein, 15 aa, Artificial sequence
  Synthetic peptide
YIPMDDDFQLRSFDQ

SEQ ID NO: 2216 - protein, 15 aa, Artificial sequence
  Synthetic peptide
IPMDDDFQLRSFDQL

SEQ ID NO: 2217 - protein, 15 aa, Artificial sequence
  Synthetic peptide
PMDDDFQLRSFDQLS

SEQ ID NO: 2218 - protein, 15 aa, Artificial sequence
  Synthetic peptide
MDDDFQLRSFDQLSP

SEQ ID NO: 2219 - protein, 15 aa, Artificial sequence
  Synthetic peptide
DDDFQLRSFDQLSPL

SEQ ID NO: 2220 - protein, 15 aa, Artificial sequence
  Synthetic peptide
DDFQLRSFDQLSPLE

SEQ ID NO: 2221 - protein, 15 aa, Artificial sequence
  Synthetic peptide
DFQLRSFDQLSPLES

SEQ ID NO: 2222 - protein, 15 aa, Artificial sequence
  Synthetic peptide
FQLRSFDQLSPLESS

SEQ ID NO: 2223 - protein, 15 aa, Artificial sequence
  Synthetic peptide
QLRSFDQLSPLESSS

SEQ ID NO: 2224 - protein, 15 aa, Artificial sequence
  Synthetic peptide
LRSFDQLSPLESSSA

SEQ ID NO: 2225 - protein, 15 aa, Artificial sequence
  Synthetic peptide
RSFDQLSPLESSSAS

SEQ ID NO: 2226 - protein, 15 aa, Artificial sequence
  Synthetic peptide
SFDQLSPLESSSASP

SEQ ID NO: 2227 - protein, 15 aa, Artificial sequence
  Synthetic peptide
FDQLSPLESSSASPE

SEQ ID NO: 2228 - protein, 15 aa, Artificial sequence
  Synthetic peptide
DQLSPLESSSASPES

SEQ ID NO: 2229 - protein, 15 aa, Artificial sequence
  Synthetic peptide
QLSPLESSSASPESA

SEQ ID NO: 2230 - protein, 15 aa, Artificial sequence
  Synthetic peptide
LSPLESSSASPESAS

SEQ ID NO: 2231 - protein, 15 aa, Artificial sequence
  Synthetic peptide
SPLESSSASPESASP

SEQ ID NO: 2232 - protein, 15 aa, Artificial sequence
  Synthetic peptide
PLESSSASPESASPQ

SEQ ID NO: 2233 - protein, 15 aa, Artificial sequence
  Synthetic peptide
LESSSASPESASPQS

SEQ ID NO: 2234 - protein, 15 aa, Artificial sequence
  Synthetic peptide
ESSSASPESASPQST

SEQ ID NO: 2235 - protein, 15 aa, Artificial sequence
  Synthetic peptide
SSSASPESASPQSTV

SEQ ID NO: 2236 - protein, 15 aa, Artificial sequence
  Synthetic peptide
SSASPESASPQSTVT

SEQ ID NO: 2237 - protein, 15 aa, Artificial sequence
  Synthetic peptide
SASPESASPQSTVTV

SEQ ID NO: 2238 - protein, 15 aa, Artificial sequence
  Synthetic peptide
ASPESASPQSTVTVF

SEQ ID NO: 2239 - protein, 15 aa, Artificial sequence
  Synthetic peptide
SPESASPQSTVTVFQ

SEQ ID NO: 2240 - protein, 15 aa, Artificial sequence
  Synthetic peptide
PESASPQSTVTVFQQ

SEQ ID NO: 2241 - protein, 15 aa, Artificial sequence
  Synthetic peptide
ESASPQSTVTVFQQT

SEQ ID NO: 2242 - protein, 15 aa, Artificial sequence
  Synthetic peptide
SASPQSTVTVFQQTQ

SEQ ID NO: 2243 - protein, 15 aa, Artificial sequence
  Synthetic peptide
ASPQSTVTVFQQTQI

SEQ ID NO: 2244 - protein, 15 aa, Artificial sequence
  Synthetic peptide
SPQSTVTVFQQTQIQ

SEQ ID NO: 2245 - protein, 15 aa, Artificial sequence
  Synthetic peptide
PQSTVTVFQQTQIQE

SEQ ID NO: 2246 - protein, 15 aa, Artificial sequence
  Synthetic peptide
QSTVTVFQQTQIQEP

SEQ ID NO: 2247 - protein, 15 aa, Artificial sequence
  Synthetic peptide
STVTVFQQTQIQEPT

SEQ ID NO: 2248 - protein, 15 aa, Artificial sequence
  Synthetic peptide
TVTVFQQTQIQEPTA

SEQ ID NO: 2249 - protein, 15 aa, Artificial sequence
  Synthetic peptide
VTVFQQTQIQEPTAN

SEQ ID NO: 2250 - protein, 15 aa, Artificial sequence
  Synthetic peptide
TVFQQTQIQEPTANA

SEQ ID NO: 2251 - protein, 15 aa, Artificial sequence
  Synthetic peptide
VFQQTQIQEPTANAT

SEQ ID NO: 2252 - protein, 15 aa, Artificial sequence
  Synthetic peptide
FQQTQIQEPTANATT

SEQ ID NO: 2253 - protein, 15 aa, Artificial sequence
  Synthetic peptide
QQTQIQEPTANATTT

SEQ ID NO: 2254 - protein, 15 aa, Artificial sequence
  Synthetic peptide
QTQIQEPTANATTTT

SEQ ID NO: 2255 - protein, 15 aa, Artificial sequence
  Synthetic peptide
TQIQEPTANATTTTA

SEQ ID NO: 2256 - protein, 15 aa, Artificial sequence
  Synthetic peptide
QIQEPTANATTTTAT

SEQ ID NO: 2257 - protein, 15 aa, Artificial sequence
  Synthetic peptide
IQEPTANATTTTATT

SEQ ID NO: 2258 - protein, 15 aa, Artificial sequence
  Synthetic peptide
QEPTANATTTTATTD

SEQ ID NO: 2259 - protein, 15 aa, Artificial sequence
  Synthetic peptide
EPTANATTTTATTDE

SEQ ID NO: 2260 - protein, 15 aa, Artificial sequence
  Synthetic peptide
PTANATTTTATTDEL

SEQ ID NO: 2261 - protein, 15 aa, Artificial sequence
  Synthetic peptide
TANATTTTATTDELK

SEQ ID NO: 2262 - protein, 15 aa, Artificial sequence
  Synthetic peptide
ANATTTTATTDELKT

SEQ ID NO: 2263 - protein, 15 aa, Artificial sequence
  Synthetic peptide
NATTTTATTDELKTV

SEQ ID NO: 2264 - protein, 15 aa, Artificial sequence
  Synthetic peptide
ATTTTATTDELKTVT

SEQ ID NO: 2265 - protein, 15 aa, Artificial sequence
  Synthetic peptide
TTTTATTDELKTVTK

SEQ ID NO: 2266 - protein, 15 aa, Artificial sequence
  Synthetic peptide
TTTATTDELKTVTKD

SEQ ID NO: 2267 - protein, 15 aa, Artificial sequence
  Synthetic peptide
TTATTDELKTVTKDR

SEQ ID NO: 2268 - protein, 15 aa, Artificial sequence
  Synthetic peptide
TATTDELKTVTKDRM

SEQ ID NO: 2269 - protein, 15 aa, Artificial sequence
  Synthetic peptide
ATTDELKTVTKDRME

SEQ ID NO: 2270 - protein, 15 aa, Artificial sequence
  Synthetic peptide
TTDELKTVTKDRMED

SEQ ID NO: 2271 - protein, 15 aa, Artificial sequence
  Synthetic peptide
TDELKTVTKDRMEDI

SEQ ID NO: 2272 - protein, 15 aa, Artificial sequence
  Synthetic peptide
DELKTVTKDRMEDIK

SEQ ID NO: 2273 - protein, 15 aa, Artificial sequence
  Synthetic peptide
ELKTVTKDRMEDIKI

SEQ ID NO: 2274 - protein, 15 aa, Artificial sequence
  Synthetic peptide
LKTVTKDRMEDIKIL

SEQ ID NO: 2275 - protein, 15 aa, Artificial sequence
  Synthetic peptide
KTVTKDRMEDIKILI

SEQ ID NO: 2276 - protein, 15 aa, Artificial sequence
  Synthetic peptide
TVTKDRMEDIKILIA

SEQ ID NO: 2277 - protein, 15 aa, Artificial sequence
  Synthetic peptide
VTKDRMEDIKILIAS

SEQ ID NO: 2278 - protein, 15 aa, Artificial sequence
  Synthetic peptide
TKDRMEDIKILIASP

SEQ ID NO: 2279 - protein, 15 aa, Artificial sequence
  Synthetic peptide
KDRMEDIKILIASPS

SEQ ID NO: 2280 - protein, 15 aa, Artificial sequence
  Synthetic peptide
DRMEDIKILIASPSP

SEQ ID NO: 2281 - protein, 15 aa, Artificial sequence
  Synthetic peptide
RMEDIKILIASPSPT

SEQ ID NO: 2282 - protein, 15 aa, Artificial sequence
  Synthetic peptide
MEDIKILIASPSPTH

SEQ ID NO: 2283 - protein, 15 aa, Artificial sequence
  Synthetic peptide
EDIKILIASPSPTHI

SEQ ID NO: 2284 - protein, 15 aa, Artificial sequence
  Synthetic peptide
DIKILIASPSPTHIH

SEQ ID NO: 2285 - protein, 15 aa, Artificial sequence
  Synthetic peptide
IKILIASPSPTHIHK

SEQ ID NO: 2286 - protein, 15 aa, Artificial sequence
  Synthetic peptide
KILIASPSPTHIHKE

SEQ ID NO: 2287 - protein, 15 aa, Artificial sequence
  Synthetic peptide
ILIASPSPTHIHKET

SEQ ID NO: 2288 - protein, 15 aa, Artificial sequence
  Synthetic peptide
LIASPSPTHIHKETT

SEQ ID NO: 2289 - protein, 15 aa, Artificial sequence
  Synthetic peptide
IASPSPTHIHKETTS

SEQ ID NO: 2290 - protein, 15 aa, Artificial sequence
  Synthetic peptide
ASPSPTHIHKETTSA

SEQ ID NO: 2291 - protein, 15 aa, Artificial sequence
  Synthetic peptide
SPSPTHIHKETTSAT

SEQ ID NO: 2292 - protein, 15 aa, Artificial sequence
  Synthetic peptide
PSPTHIHKETTSATS

SEQ ID NO: 2293 - protein, 15 aa, Artificial sequence
  Synthetic peptide
SPTHIHKETTSATSS

SEQ ID NO: 2294 - protein, 15 aa, Artificial sequence
  Synthetic peptide
PTHIHKETTSATSSP

SEQ ID NO: 2295 - protein, 15 aa, Artificial sequence
  Synthetic peptide
THIHKETTSATSSPY

SEQ ID NO: 2296 - protein, 15 aa, Artificial sequence
  Synthetic peptide
HIHKETTSATSSPYR

SEQ ID NO: 2297 - protein, 15 aa, Artificial sequence
  Synthetic peptide
IHKETTSATSSPYRD

SEQ ID NO: 2298 - protein, 15 aa, Artificial sequence
  Synthetic peptide
HKETTSATSSPYRDT

SEQ ID NO: 2299 - protein, 15 aa, Artificial sequence
  Synthetic peptide
KETTSATSSPYRDTQ

SEQ ID NO: 2300 - protein, 15 aa, Artificial sequence
  Synthetic peptide
ETTSATSSPYRDTQS

SEQ ID NO: 2301 - protein, 15 aa, Artificial sequence
  Synthetic peptide
TTSATSSPYRDTQSR

SEQ ID NO: 2302 - protein, 15 aa, Artificial sequence
  Synthetic peptide
TSATSSPYRDTQSRT

SEQ ID NO: 2303 - protein, 15 aa, Artificial sequence
  Synthetic peptide
SATSSPYRDTQSRTA

SEQ ID NO: 2304 - protein, 15 aa, Artificial sequence
  Synthetic peptide
ATSSPYRDTQSRTAS

SEQ ID NO: 2305 - protein, 15 aa, Artificial sequence
  Synthetic peptide
TSSPYRDTQSRTASP

SEQ ID NO: 2306 - protein, 15 aa, Artificial sequence
  Synthetic peptide
SSPYRDTQSRTASPN

SEQ ID NO: 2307 - protein, 15 aa, Artificial sequence
  Synthetic peptide
SPYRDTQSRTASPNR

SEQ ID NO: 2308 - protein, 15 aa, Artificial sequence
  Synthetic peptide
PYRDTQSRTASPNRA

SEQ ID NO: 2309 - protein, 15 aa, Artificial sequence
  Synthetic peptide
YRDTQSRTASPNRAG

SEQ ID NO: 2310 - protein, 15 aa, Artificial sequence
  Synthetic peptide
RDTQSRTASPNRAGK

SEQ ID NO: 2311 - protein, 15 aa, Artificial sequence
  Synthetic peptide
DTQSRTASPNRAGKG

SEQ ID NO: 2312 - protein, 15 aa, Artificial sequence
  Synthetic peptide
TQSRTASPNRAGKGV

SEQ ID NO: 2313 - protein, 15 aa, Artificial sequence
  Synthetic peptide
QSRTASPNRAGKGVI

SEQ ID NO: 2314 - protein, 15 aa, Artificial sequence
  Synthetic peptide
SRTASPNRAGKGVIE

SEQ ID NO: 2315 - protein, 15 aa, Artificial sequence
  Synthetic peptide
RTASPNRAGKGVIEQ

SEQ ID NO: 2316 - protein, 15 aa, Artificial sequence
  Synthetic peptide
TASPNRAGKGVIEQT

SEQ ID NO: 2317 - protein, 15 aa, Artificial sequence
  Synthetic peptide
ASPNRAGKGVIEQTE

SEQ ID NO: 2318 - protein, 15 aa, Artificial sequence
  Synthetic peptide
SPNRAGKGVIEQTEK

SEQ ID NO: 2319 - protein, 15 aa, Artificial sequence
  Synthetic peptide
PNRAGKGVIEQTEKS

SEQ ID NO: 2320 - protein, 15 aa, Artificial sequence
  Synthetic peptide
NRAGKGVIEQTEKSH

SEQ ID NO: 2321 - protein, 15 aa, Artificial sequence
  Synthetic peptide
RAGKGVIEQTEKSHP

SEQ ID NO: 2322 - protein, 15 aa, Artificial sequence
  Synthetic peptide
AGKGVIEQTEKSHPR

SEQ ID NO: 2323 - protein, 15 aa, Artificial sequence
  Synthetic peptide
GKGVIEQTEKSHPRS

SEQ ID NO: 2324 - protein, 15 aa, Artificial sequence
  Synthetic peptide
KGVIEQTEKSHPRSP

SEQ ID NO: 2325 - protein, 15 aa, Artificial sequence
  Synthetic peptide
GVIEQTEKSHPRSPN

SEQ ID NO: 2326 - protein, 15 aa, Artificial sequence
  Synthetic peptide
VIEQTEKSHPRSPNV

SEQ ID NO: 2327 - protein, 15 aa, Artificial sequence
  Synthetic peptide
IEQTEKSHPRSPNVL

SEQ ID NO: 2328 - protein, 15 aa, Artificial sequence
  Synthetic peptide
EQTEKSHPRSPNVLS

SEQ ID NO: 2329 - protein, 15 aa, Artificial sequence
  Synthetic peptide
QTEKSHPRSPNVLSV

SEQ ID NO: 2330 - protein, 15 aa, Artificial sequence
  Synthetic peptide
TEKSHPRSPNVLSVA

SEQ ID NO: 2331 - protein, 15 aa, Artificial sequence
  Synthetic peptide
EKSHPRSPNVLSVAL

SEQ ID NO: 2332 - protein, 15 aa, Artificial sequence
  Synthetic peptide
KSHPRSPNVLSVALS

SEQ ID NO: 2333 - protein, 15 aa, Artificial sequence
  Synthetic peptide
SHPRSPNVLSVALSQ

SEQ ID NO: 2334 - protein, 15 aa, Artificial sequence
  Synthetic peptide
HPRSPNVLSVALSQR

SEQ ID NO: 2335 - protein, 15 aa, Artificial sequence
  Synthetic peptide
PRSPNVLSVALSQRT

SEQ ID NO: 2336 - protein, 15 aa, Artificial sequence
  Synthetic peptide
RSPNVLSVALSQRTT

SEQ ID NO: 2337 - protein, 15 aa, Artificial sequence
  Synthetic peptide
SPNVLSVALSQRTTV

SEQ ID NO: 2338 - protein, 15 aa, Artificial sequence
  Synthetic peptide
PNVLSVALSQRTTVP

SEQ ID NO: 2339 - protein, 15 aa, Artificial sequence
  Synthetic peptide
NVLSVALSQRTTVPE

SEQ ID NO: 2340 - protein, 15 aa, Artificial sequence
  Synthetic peptide
VLSVALSQRTTVPEE

SEQ ID NO: 2341 - protein, 15 aa, Artificial sequence
  Synthetic peptide
LSVALSQRTTVPEEE

SEQ ID NO: 2342 - protein, 15 aa, Artificial sequence
  Synthetic peptide
SVALSQRTTVPEEEL

SEQ ID NO: 2343 - protein, 15 aa, Artificial sequence
  Synthetic peptide
VALSQRTTVPEEELN

SEQ ID NO: 2344 - protein, 15 aa, Artificial sequence
  Synthetic peptide
ALSQRTTVPEEELNP

SEQ ID NO: 2345 - protein, 15 aa, Artificial sequence
  Synthetic peptide
LSQRTTVPEEELNPK

SEQ ID NO: 2346 - protein, 15 aa, Artificial sequence
  Synthetic peptide
SQRTTVPEEELNPKI

SEQ ID NO: 2347 - protein, 15 aa, Artificial sequence
  Synthetic peptide
QRTTVPEEELNPKIL

SEQ ID NO: 2348 - protein, 15 aa, Artificial sequence
  Synthetic peptide
RTTVPEEELNPKILA

SEQ ID NO: 2349 - protein, 15 aa, Artificial sequence
  Synthetic peptide
TTVPEEELNPKILAL

SEQ ID NO: 2350 - protein, 15 aa, Artificial sequence
  Synthetic peptide
TVPEEELNPKILALQ

SEQ ID NO: 2351 - protein, 15 aa, Artificial sequence
  Synthetic peptide
VPEEELNPKILALQN

SEQ ID NO: 2352 - protein, 15 aa, Artificial sequence
  Synthetic peptide
PEEELNPKILALQNA

SEQ ID NO: 2353 - protein, 15 aa, Artificial sequence
  Synthetic peptide
EEELNPKILALQNAQ

SEQ ID NO: 2354 - protein, 15 aa, Artificial sequence
  Synthetic peptide
EELNPKILALQNAQR

SEQ ID NO: 2355 - protein, 15 aa, Artificial sequence
  Synthetic peptide
ELNPKILALQNAQRK

SEQ ID NO: 2356 - protein, 15 aa, Artificial sequence
  Synthetic peptide
LNPKILALQNAQRKR

SEQ ID NO: 2357 - protein, 15 aa, Artificial sequence
  Synthetic peptide
NPKILALQNAQRKRK

SEQ ID NO: 2358 - protein, 15 aa, Artificial sequence
  Synthetic peptide
PKILALQNAQRKRKM

SEQ ID NO: 2359 - protein, 15 aa, Artificial sequence
  Synthetic peptide
KILALQNAQRKRKME

SEQ ID NO: 2360 - protein, 15 aa, Artificial sequence
  Synthetic peptide
ILALQNAQRKRKMEH

SEQ ID NO: 2361 - protein, 15 aa, Artificial sequence
  Synthetic peptide
LALQNAQRKRKMEHD

SEQ ID NO: 2362 - protein, 15 aa, Artificial sequence
  Synthetic peptide
ALQNAQRKRKMEHDG

SEQ ID NO: 2363 - protein, 15 aa, Artificial sequence
  Synthetic peptide
LQNAQRKRKMEHDGS

SEQ ID NO: 2364 - protein, 15 aa, Artificial sequence
  Synthetic peptide
QNAQRKRKMEHDGSL

SEQ ID NO: 2365 - protein, 15 aa, Artificial sequence
  Synthetic peptide
NAQRKRKMEHDGSLF

SEQ ID NO: 2366 - protein, 15 aa, Artificial sequence
  Synthetic peptide
AQRKRKMEHDGSLFQ

SEQ ID NO: 2367 - protein, 15 aa, Artificial sequence
  Synthetic peptide
QRKRKMEHDGSLFQA

SEQ ID NO: 2368 - protein, 15 aa, Artificial sequence
  Synthetic peptide
RKRKMEHDGSLFQAV

SEQ ID NO: 2369 - protein, 15 aa, Artificial sequence
  Synthetic peptide
KRKMEHDGSLFQAVG

SEQ ID NO: 2370 - protein, 15 aa, Artificial sequence
  Synthetic peptide
RKMEHDGSLFQAVGI

SEQ ID NO: 2371 - protein, 15 aa, Artificial sequence
  Synthetic peptide
KMEHDGSLFQAVGIG

SEQ ID NO: 2372 - protein, 15 aa, Artificial sequence
  Synthetic peptide
MEHDGSLFQAVGIGT

SEQ ID NO: 2373 - protein, 15 aa, Artificial sequence
  Synthetic peptide
EHDGSLFQAVGIGTL

SEQ ID NO: 2374 - protein, 15 aa, Artificial sequence
  Synthetic peptide
HDGSLFQAVGIGTLL

SEQ ID NO: 2375 - protein, 15 aa, Artificial sequence
  Synthetic peptide
DGSLFQAVGIGTLLQ

SEQ ID NO: 2376 - protein, 15 aa, Artificial sequence
  Synthetic peptide
GSLFQAVGIGTLLQQ

SEQ ID NO: 2377 - protein, 15 aa, Artificial sequence
  Synthetic peptide
SLFQAVGIGTLLQQP

SEQ ID NO: 2378 - protein, 15 aa, Artificial sequence
  Synthetic peptide
LFQAVGIGTLLQQPD

SEQ ID NO: 2379 - protein, 15 aa, Artificial sequence
  Synthetic peptide
FQAVGIGTLLQQPDD

SEQ ID NO: 2380 - protein, 15 aa, Artificial sequence
  Synthetic peptide
QAVGIGTLLQQPDDH

SEQ ID NO: 2381 - protein, 15 aa, Artificial sequence
  Synthetic peptide
AVGIGTLLQQPDDHA

SEQ ID NO: 2382 - protein, 15 aa, Artificial sequence
  Synthetic peptide
VGIGTLLQQPDDHAA

SEQ ID NO: 2383 - protein, 15 aa, Artificial sequence
  Synthetic peptide
GIGTLLQQPDDHAAT

SEQ ID NO: 2384 - protein, 15 aa, Artificial sequence
  Synthetic peptide
IGTLLQQPDDHAATT

SEQ ID NO: 2385 - protein, 15 aa, Artificial sequence
  Synthetic peptide
GTLLQQPDDHAATTS

SEQ ID NO: 2386 - protein, 15 aa, Artificial sequence
  Synthetic peptide
TLLQQPDDHAATTSL

SEQ ID NO: 2387 - protein, 15 aa, Artificial sequence
  Synthetic peptide
LLQQPDDHAATTSLS

SEQ ID NO: 2388 - protein, 15 aa, Artificial sequence
  Synthetic peptide
LQQPDDHAATTSLSW

SEQ ID NO: 2389 - protein, 15 aa, Artificial sequence
  Synthetic peptide
QQPDDHAATTSLSWK

SEQ ID NO: 2390 - protein, 15 aa, Artificial sequence
  Synthetic peptide
QPDDHAATTSLSWKR

SEQ ID NO: 2391 - protein, 15 aa, Artificial sequence
  Synthetic peptide
PDDHAATTSLSWKRV

SEQ ID NO: 2392 - protein, 15 aa, Artificial sequence
  Synthetic peptide
DDHAATTSLSWKRVK

SEQ ID NO: 2393 - protein, 15 aa, Artificial sequence
  Synthetic peptide
DHAATTSLSWKRVKG

SEQ ID NO: 2394 - protein, 15 aa, Artificial sequence
  Synthetic peptide
HAATTSLSWKRVKGC

SEQ ID NO: 2395 - protein, 15 aa, Artificial sequence
  Synthetic peptide
AATTSLSWKRVKGCK

SEQ ID NO: 2396 - protein, 15 aa, Artificial sequence
  Synthetic peptide
ATTSLSWKRVKGCKS

SEQ ID NO: 2397 - protein, 15 aa, Artificial sequence
  Synthetic peptide
TTSLSWKRVKGCKSS

SEQ ID NO: 2398 - protein, 15 aa, Artificial sequence
  Synthetic peptide
TSLSWKRVKGCKSSE

SEQ ID NO: 2399 - protein, 15 aa, Artificial sequence
  Synthetic peptide
SLSWKRVKGCKSSEQ

SEQ ID NO: 2400 - protein, 15 aa, Artificial sequence
  Synthetic peptide
LSWKRVKGCKSSEQN

SEQ ID NO: 2401 - protein, 15 aa, Artificial sequence
  Synthetic peptide
SWKRVKGCKSSEQNG

SEQ ID NO: 2402 - protein, 15 aa, Artificial sequence
  Synthetic peptide
WKRVKGCKSSEQNGM

SEQ ID NO: 2403 - protein, 15 aa, Artificial sequence
  Synthetic peptide
KRVKGCKSSEQNGME

SEQ ID NO: 2404 - protein, 15 aa, Artificial sequence
  Synthetic peptide
RVKGCKSSEQNGMEQ

SEQ ID NO: 2405 - protein, 15 aa, Artificial sequence
  Synthetic peptide
VKGCKSSEQNGMEQK

SEQ ID NO: 2406 - protein, 15 aa, Artificial sequence
  Synthetic peptide
KGCKSSEQNGMEQKT

SEQ ID NO: 2407 - protein, 15 aa, Artificial sequence
  Synthetic peptide
GCKSSEQNGMEQKTI

SEQ ID NO: 2408 - protein, 15 aa, Artificial sequence
  Synthetic peptide
CKSSEQNGMEQKTII

SEQ ID NO: 2409 - protein, 15 aa, Artificial sequence
  Synthetic peptide
KSSEQNGMEQKTIIL

SEQ ID NO: 2410 - protein, 15 aa, Artificial sequence
  Synthetic peptide
SSEQNGMEQKTIILI

SEQ ID NO: 2411 - protein, 15 aa, Artificial sequence
  Synthetic peptide
SEQNGMEQKTIILIP

SEQ ID NO: 2412 - protein, 15 aa, Artificial sequence
  Synthetic peptide
EQNGMEQKTIILIPS

SEQ ID NO: 2413 - protein, 15 aa, Artificial sequence
  Synthetic peptide
QNGMEQKTIILIPSD

SEQ ID NO: 2414 - protein, 15 aa, Artificial sequence
  Synthetic peptide
NGMEQKTIILIPSDL

SEQ ID NO: 2415 - protein, 15 aa, Artificial sequence
  Synthetic peptide
GMEQKTIILIPSDLA

SEQ ID NO: 2416 - protein, 15 aa, Artificial sequence
  Synthetic peptide
MEQKTIILIPSDLAC

SEQ ID NO: 2417 - protein, 15 aa, Artificial sequence
  Synthetic peptide
EQKTIILIPSDLACR

SEQ ID NO: 2418 - protein, 15 aa, Artificial sequence
  Synthetic peptide
QKTIILIPSDLACRL

SEQ ID NO: 2419 - protein, 15 aa, Artificial sequence
  Synthetic peptide
KTIILIPSDLACRLL

SEQ ID NO: 2420 - protein, 15 aa, Artificial sequence
  Synthetic peptide
TIILIPSDLACRLLG

SEQ ID NO: 2421 - protein, 15 aa, Artificial sequence
  Synthetic peptide
IILIPSDLACRLLGQ

SEQ ID NO: 2422 - protein, 15 aa, Artificial sequence
  Synthetic peptide
ILIPSDLACRLLGQS

SEQ ID NO: 2423 - protein, 15 aa, Artificial sequence
  Synthetic peptide
LIPSDLACRLLGQSM

SEQ ID NO: 2424 - protein, 15 aa, Artificial sequence
  Synthetic peptide
IPSDLACRLLGQSMD

SEQ ID NO: 2425 - protein, 15 aa, Artificial sequence
  Synthetic peptide
PSDLACRLLGQSMDE

SEQ ID NO: 2426 - protein, 15 aa, Artificial sequence
  Synthetic peptide
SDLACRLLGQSMDES

SEQ ID NO: 2427 - protein, 15 aa, Artificial sequence
  Synthetic peptide
DLACRLLGQSMDESG

SEQ ID NO: 2428 - protein, 15 aa, Artificial sequence
  Synthetic peptide
LACRLLGQSMDESGL

SEQ ID NO: 2429 - protein, 15 aa, Artificial sequence
  Synthetic peptide
ACRLLGQSMDESGLP

SEQ ID NO: 2430 - protein, 15 aa, Artificial sequence
  Synthetic peptide
CRLLGQSMDESGLPQ

SEQ ID NO: 2431 - protein, 15 aa, Artificial sequence
  Synthetic peptide
RLLGQSMDESGLPQL

SEQ ID NO: 2432 - protein, 15 aa, Artificial sequence
  Synthetic peptide
LLGQSMDESGLPQLT

SEQ ID NO: 2433 - protein, 15 aa, Artificial sequence
  Synthetic peptide
LGQSMDESGLPQLTS

SEQ ID NO: 2434 - protein, 15 aa, Artificial sequence
  Synthetic peptide
GQSMDESGLPQLTSY

SEQ ID NO: 2435 - protein, 15 aa, Artificial sequence
  Synthetic peptide
QSMDESGLPQLTSYD

SEQ ID NO: 2436 - protein, 15 aa, Artificial sequence
  Synthetic peptide
SMDESGLPQLTSYDC

SEQ ID NO: 2437 - protein, 15 aa, Artificial sequence
  Synthetic peptide
MDESGLPQLTSYDCE

SEQ ID NO: 2438 - protein, 15 aa, Artificial sequence
  Synthetic peptide
DESGLPQLTSYDCEV

SEQ ID NO: 2439 - protein, 15 aa, Artificial sequence
  Synthetic peptide
ESGLPQLTSYDCEVN

SEQ ID NO: 2440 - protein, 15 aa, Artificial sequence
  Synthetic peptide
SGLPQLTSYDCEVNA

SEQ ID NO: 2441 - protein, 15 aa, Artificial sequence
  Synthetic peptide
GLPQLTSYDCEVNAP

SEQ ID NO: 2442 - protein, 15 aa, Artificial sequence
  Synthetic peptide
LPQLTSYDCEVNAPI

SEQ ID NO: 2443 - protein, 15 aa, Artificial sequence
  Synthetic peptide
PQLTSYDCEVNAPIQ

SEQ ID NO: 2444 - protein, 15 aa, Artificial sequence
  Synthetic peptide
QLTSYDCEVNAPIQG

SEQ ID NO: 2445 - protein, 15 aa, Artificial sequence
  Synthetic peptide
LTSYDCEVNAPIQGS

SEQ ID NO: 2446 - protein, 15 aa, Artificial sequence
  Synthetic peptide
TSYDCEVNAPIQGSR

SEQ ID NO: 2447 - protein, 15 aa, Artificial sequence
  Synthetic peptide
SYDCEVNAPIQGSRN

SEQ ID NO: 2448 - protein, 15 aa, Artificial sequence
  Synthetic peptide
YDCEVNAPIQGSRNL

SEQ ID NO: 2449 - protein, 15 aa, Artificial sequence
  Synthetic peptide
DCEVNAPIQGSRNLL

SEQ ID NO: 2450 - protein, 15 aa, Artificial sequence
  Synthetic peptide
CEVNAPIQGSRNLLQ

SEQ ID NO: 2451 - protein, 15 aa, Artificial sequence
  Synthetic peptide
EVNAPIQGSRNLLQG

SEQ ID NO: 2452 - protein, 15 aa, Artificial sequence
  Synthetic peptide
VNAPIQGSRNLLQGE

SEQ ID NO: 2453 - protein, 15 aa, Artificial sequence
  Synthetic peptide
NAPIQGSRNLLQGEE

SEQ ID NO: 2454 - protein, 15 aa, Artificial sequence
  Synthetic peptide
APIQGSRNLLQGEEL

SEQ ID NO: 2455 - protein, 15 aa, Artificial sequence
  Synthetic peptide
PIQGSRNLLQGEELL

SEQ ID NO: 2456 - protein, 15 aa, Artificial sequence
  Synthetic peptide
IQGSRNLLQGEELLR

SEQ ID NO: 2457 - protein, 15 aa, Artificial sequence
  Synthetic peptide
QGSRNLLQGEELLRA

SEQ ID NO: 2458 - protein, 15 aa, Artificial sequence
  Synthetic peptide
GSRNLLQGEELLRAL

SEQ ID NO: 2459 - protein, 15 aa, Artificial sequence
  Synthetic peptide
SRNLLQGEELLRALD

SEQ ID NO: 2460 - protein, 15 aa, Artificial sequence
  Synthetic peptide
RNLLQGEELLRALDQ

SEQ ID NO: 2461 - protein, 15 aa, Artificial sequence
  Synthetic peptide
NLLQGEELLRALDQV

SEQ ID NO: 2462 - protein, 15 aa, Artificial sequence
  Synthetic peptide
LLQGEELLRALDQVN

SEQ ID NO: 2463 - protein, 5 aa, Artificial sequence
  Synthetic peptide
MKKSY

SEQ ID NO: 2464 - protein, 5 aa, Artificial sequence
  Synthetic peptide
KKSYS

SEQ ID NO: 2465 - protein, 5 aa, Artificial sequence
  Synthetic peptide
KSYSG

SEQ ID NO: 2466 - protein, 5 aa, Artificial sequence
  Synthetic peptide
SYSGG

SEQ ID NO: 2467 - protein, 5 aa, Artificial sequence
  Synthetic peptide
YSGGT

SEQ ID NO: 2468 - protein, 5 aa, Artificial sequence
  Synthetic peptide
SGGTR

SEQ ID NO: 2469 - protein, 5 aa, Artificial sequence
  Synthetic peptide
GGTRT

SEQ ID NO: 2470 - protein, 5 aa, Artificial sequence
  Synthetic peptide
GTRTS

SEQ ID NO: 2471 - protein, 5 aa, Artificial sequence
  Synthetic peptide
TRTSS

SEQ ID NO: 2472 - protein, 5 aa, Artificial sequence
  Synthetic peptide
RTSSG

SEQ ID NO: 2473 - protein, 5 aa, Artificial sequence
  Synthetic peptide
TSSGR

SEQ ID NO: 2474 - protein, 5 aa, Artificial sequence
  Synthetic peptide
SSGRL

SEQ ID NO: 2475 - protein, 5 aa, Artificial sequence
  Synthetic peptide
SGRLR

SEQ ID NO: 2476 - protein, 5 aa, Artificial sequence
  Synthetic peptide
GRLRR

SEQ ID NO: 2477 - protein, 5 aa, Artificial sequence
  Synthetic peptide
RLRRL

SEQ ID NO: 2478 - protein, 5 aa, Artificial sequence
  Synthetic peptide
LRRLG

SEQ ID NO: 2479 - protein, 5 aa, Artificial sequence
  Synthetic peptide
RRLGD

SEQ ID NO: 2480 - protein, 5 aa, Artificial sequence
  Synthetic peptide
RLGDS

SEQ ID NO: 2481 - protein, 5 aa, Artificial sequence
  Synthetic peptide
LGDSS

SEQ ID NO: 2482 - protein, 5 aa, Artificial sequence
  Synthetic peptide
GDSSG

SEQ ID NO: 2483 - protein, 5 aa, Artificial sequence
  Synthetic peptide
DSSGP

SEQ ID NO: 2484 - protein, 5 aa, Artificial sequence
  Synthetic peptide
SSGPA

SEQ ID NO: 2485 - protein, 5 aa, Artificial sequence
  Synthetic peptide
SGPAL

SEQ ID NO: 2486 - protein, 5 aa, Artificial sequence
  Synthetic peptide
GPALK

SEQ ID NO: 2487 - protein, 5 aa, Artificial sequence
  Synthetic peptide
PALKR

SEQ ID NO: 2488 - protein, 5 aa, Artificial sequence
  Synthetic peptide
ALKRS

SEQ ID NO: 2489 - protein, 5 aa, Artificial sequence
  Synthetic peptide
LKRSF

SEQ ID NO: 2490 - protein, 5 aa, Artificial sequence
  Synthetic peptide
KRSFE

SEQ ID NO: 2491 - protein, 5 aa, Artificial sequence
  Synthetic peptide
RSFEV

SEQ ID NO: 2492 - protein, 5 aa, Artificial sequence
  Synthetic peptide
SFEVE

SEQ ID NO: 2493 - protein, 5 aa, Artificial sequence
  Synthetic peptide
FEVEE

SEQ ID NO: 2494 - protein, 5 aa, Artificial sequence
  Synthetic peptide
EVEEV

SEQ ID NO: 2495 - protein, 5 aa, Artificial sequence
  Synthetic peptide
VEEVE

SEQ ID NO: 2496 - protein, 5 aa, Artificial sequence
  Synthetic peptide
EEVET

SEQ ID NO: 2497 - protein, 5 aa, Artificial sequence
  Synthetic peptide
EVETP

SEQ ID NO: 2498 - protein, 5 aa, Artificial sequence
  Synthetic peptide
VETPN

SEQ ID NO: 2499 - protein, 5 aa, Artificial sequence
  Synthetic peptide
ETPNS

SEQ ID NO: 2500 - protein, 5 aa, Artificial sequence
  Synthetic peptide
TPNST

SEQ ID NO: 2501 - protein, 5 aa, Artificial sequence
  Synthetic peptide
PNSTP

SEQ ID NO: 2502 - protein, 5 aa, Artificial sequence
  Synthetic peptide
NSTPP

SEQ ID NO: 2503 - protein, 5 aa, Artificial sequence
  Synthetic peptide
STPPR

SEQ ID NO: 2504 - protein, 5 aa, Artificial sequence
  Synthetic peptide
TPPRR

SEQ ID NO: 2505 - protein, 5 aa, Artificial sequence
  Synthetic peptide
PPRRV

SEQ ID NO: 2506 - protein, 5 aa, Artificial sequence
  Synthetic peptide
PRRVQ

SEQ ID NO: 2507 - protein, 5 aa, Artificial sequence
  Synthetic peptide
RRVQT

SEQ ID NO: 2508 - protein, 5 aa, Artificial sequence
  Synthetic peptide
RVQTP

SEQ ID NO: 2509 - protein, 5 aa, Artificial sequence
  Synthetic peptide
VQTPL

SEQ ID NO: 2510 - protein, 5 aa, Artificial sequence
  Synthetic peptide
QTPLL

SEQ ID NO: 2511 - protein, 5 aa, Artificial sequence
  Synthetic peptide
TPLLR

SEQ ID NO: 2512 - protein, 5 aa, Artificial sequence
  Synthetic peptide
PLLRA

SEQ ID NO: 2513 - protein, 5 aa, Artificial sequence
  Synthetic peptide
LLRAT

SEQ ID NO: 2514 - protein, 5 aa, Artificial sequence
  Synthetic peptide
LRATV

SEQ ID NO: 2515 - protein, 5 aa, Artificial sequence
  Synthetic peptide
RATVA

SEQ ID NO: 2516 - protein, 5 aa, Artificial sequence
  Synthetic peptide
ATVAS

SEQ ID NO: 2517 - protein, 5 aa, Artificial sequence
  Synthetic peptide
TVASS

SEQ ID NO: 2518 - protein, 5 aa, Artificial sequence
  Synthetic peptide
VASST

SEQ ID NO: 2519 - protein, 5 aa, Artificial sequence
  Synthetic peptide
ASSTQ

SEQ ID NO: 2520 - protein, 5 aa, Artificial sequence
  Synthetic peptide
SSTQK

SEQ ID NO: 2521 - protein, 5 aa, Artificial sequence
  Synthetic peptide
STQKF

SEQ ID NO: 2522 - protein, 5 aa, Artificial sequence
  Synthetic peptide
TQKFQ

SEQ ID NO: 2523 - protein, 5 aa, Artificial sequence
  Synthetic peptide
QKFQD

SEQ ID NO: 2524 - protein, 5 aa, Artificial sequence
  Synthetic peptide
KFQDL

SEQ ID NO: 2525 - protein, 5 aa, Artificial sequence
  Synthetic peptide
FQDLG

SEQ ID NO: 2526 - protein, 5 aa, Artificial sequence
  Synthetic peptide
QDLGV

SEQ ID NO: 2527 - protein, 5 aa, Artificial sequence
  Synthetic peptide
DLGVK

SEQ ID NO: 2528 - protein, 5 aa, Artificial sequence
  Synthetic peptide
LGVKN

SEQ ID NO: 2529 - protein, 5 aa, Artificial sequence
  Synthetic peptide
GVKNS

SEQ ID NO: 2530 - protein, 5 aa, Artificial sequence
  Synthetic peptide
VKNSE

SEQ ID NO: 2531 - protein, 5 aa, Artificial sequence
  Synthetic peptide
KNSEP

SEQ ID NO: 2532 - protein, 5 aa, Artificial sequence
  Synthetic peptide
NSEPS

SEQ ID NO: 2533 - protein, 5 aa, Artificial sequence
  Synthetic peptide
SEPSA

SEQ ID NO: 2534 - protein, 5 aa, Artificial sequence
  Synthetic peptide
EPSAR

SEQ ID NO: 2535 - protein, 5 aa, Artificial sequence
  Synthetic peptide
PSARH

SEQ ID NO: 2536 - protein, 5 aa, Artificial sequence
  Synthetic peptide
SARHV

SEQ ID NO: 2537 - protein, 5 aa, Artificial sequence
  Synthetic peptide
ARHVD

SEQ ID NO: 2538 - protein, 5 aa, Artificial sequence
  Synthetic peptide
RHVDS

SEQ ID NO: 2539 - protein, 5 aa, Artificial sequence
  Synthetic peptide
HVDSL

SEQ ID NO: 2540 - protein, 5 aa, Artificial sequence
  Synthetic peptide
VDSLS

SEQ ID NO: 2541 - protein, 5 aa, Artificial sequence
  Synthetic peptide
DSLSQ

SEQ ID NO: 2542 - protein, 5 aa, Artificial sequence
  Synthetic peptide
SLSQR

SEQ ID NO: 2543 - protein, 5 aa, Artificial sequence
  Synthetic peptide
LSQRS

SEQ ID NO: 2544 - protein, 5 aa, Artificial sequence
  Synthetic peptide
SQRSP

SEQ ID NO: 2545 - protein, 5 aa, Artificial sequence
  Synthetic peptide
QRSPK

SEQ ID NO: 2546 - protein, 5 aa, Artificial sequence
  Synthetic peptide
RSPKA

SEQ ID NO: 2547 - protein, 5 aa, Artificial sequence
  Synthetic peptide
SPKAS

SEQ ID NO: 2548 - protein, 5 aa, Artificial sequence
  Synthetic peptide
PKASL

SEQ ID NO: 2549 - protein, 5 aa, Artificial sequence
  Synthetic peptide
KASLR

SEQ ID NO: 2550 - protein, 5 aa, Artificial sequence
  Synthetic peptide
ASLRR

SEQ ID NO: 2551 - protein, 5 aa, Artificial sequence
  Synthetic peptide
SLRRV

SEQ ID NO: 2552 - protein, 5 aa, Artificial sequence
  Synthetic peptide
LRRVE

SEQ ID NO: 2553 - protein, 5 aa, Artificial sequence
  Synthetic peptide
RRVEL

SEQ ID NO: 2554 - protein, 5 aa, Artificial sequence
  Synthetic peptide
RVELS

SEQ ID NO: 2555 - protein, 5 aa, Artificial sequence
  Synthetic peptide
VELSG

SEQ ID NO: 2556 - protein, 5 aa, Artificial sequence
  Synthetic peptide
ELSGP

SEQ ID NO: 2557 - protein, 5 aa, Artificial sequence
  Synthetic peptide
LSGPK

SEQ ID NO: 2558 - protein, 5 aa, Artificial sequence
  Synthetic peptide
SGPKA

SEQ ID NO: 2559 - protein, 5 aa, Artificial sequence
  Synthetic peptide
GPKAA

SEQ ID NO: 2560 - protein, 5 aa, Artificial sequence
  Synthetic peptide
PKAAE

SEQ ID NO: 2561 - protein, 5 aa, Artificial sequence
  Synthetic peptide
KAAEP

SEQ ID NO: 2562 - protein, 5 aa, Artificial sequence
  Synthetic peptide
AAEPV

SEQ ID NO: 2563 - protein, 5 aa, Artificial sequence
  Synthetic peptide
AEPVS

SEQ ID NO: 2564 - protein, 5 aa, Artificial sequence
  Synthetic peptide
EPVSR

SEQ ID NO: 2565 - protein, 5 aa, Artificial sequence
  Synthetic peptide
PVSRR

SEQ ID NO: 2566 - protein, 5 aa, Artificial sequence
  Synthetic peptide
VSRRT

SEQ ID NO: 2567 - protein, 5 aa, Artificial sequence
  Synthetic peptide
SRRTE

SEQ ID NO: 2568 - protein, 5 aa, Artificial sequence
  Synthetic peptide
RRTEL

SEQ ID NO: 2569 - protein, 5 aa, Artificial sequence
  Synthetic peptide
RTELS

SEQ ID NO: 2570 - protein, 5 aa, Artificial sequence
  Synthetic peptide
TELSI

SEQ ID NO: 2571 - protein, 5 aa, Artificial sequence
  Synthetic peptide
ELSID

SEQ ID NO: 2572 - protein, 5 aa, Artificial sequence
  Synthetic peptide
LSIDI

SEQ ID NO: 2573 - protein, 5 aa, Artificial sequence
  Synthetic peptide
SIDIS

SEQ ID NO: 2574 - protein, 5 aa, Artificial sequence
  Synthetic peptide
IDISS

SEQ ID NO: 2575 - protein, 5 aa, Artificial sequence
  Synthetic peptide
DISSK

SEQ ID NO: 2576 - protein, 5 aa, Artificial sequence
  Synthetic peptide
ISSKQ

SEQ ID NO: 2577 - protein, 5 aa, Artificial sequence
  Synthetic peptide
SSKQV

SEQ ID NO: 2578 - protein, 5 aa, Artificial sequence
  Synthetic peptide
SKQVE

SEQ ID NO: 2579 - protein, 5 aa, Artificial sequence
  Synthetic peptide
KQVEN

SEQ ID NO: 2580 - protein, 5 aa, Artificial sequence
  Synthetic peptide
QVENA

SEQ ID NO: 2581 - protein, 5 aa, Artificial sequence
  Synthetic peptide
VENAG

SEQ ID NO: 2582 - protein, 5 aa, Artificial sequence
  Synthetic peptide
ENAGA

SEQ ID NO: 2583 - protein, 5 aa, Artificial sequence
  Synthetic peptide
NAGAI

SEQ ID NO: 2584 - protein, 5 aa, Artificial sequence
  Synthetic peptide
AGAIG

SEQ ID NO: 2585 - protein, 5 aa, Artificial sequence
  Synthetic peptide
GAIGP

SEQ ID NO: 2586 - protein, 5 aa, Artificial sequence
  Synthetic peptide
AIGPS

SEQ ID NO: 2587 - protein, 5 aa, Artificial sequence
  Synthetic peptide
IGPSR

SEQ ID NO: 2588 - protein, 5 aa, Artificial sequence
  Synthetic peptide
GPSRF

SEQ ID NO: 2589 - protein, 5 aa, Artificial sequence
  Synthetic peptide
PSRFG

SEQ ID NO: 2590 - protein, 5 aa, Artificial sequence
  Synthetic peptide
SRFGL

SEQ ID NO: 2591 - protein, 5 aa, Artificial sequence
  Synthetic peptide
RFGLK

SEQ ID NO: 2592 - protein, 5 aa, Artificial sequence
  Synthetic peptide
FGLKR

SEQ ID NO: 2593 - protein, 5 aa, Artificial sequence
  Synthetic peptide
GLKRA

SEQ ID NO: 2594 - protein, 5 aa, Artificial sequence
  Synthetic peptide
LKRAE

SEQ ID NO: 2595 - protein, 5 aa, Artificial sequence
  Synthetic peptide
KRAEV

SEQ ID NO: 2596 - protein, 5 aa, Artificial sequence
  Synthetic peptide
RAEVL

SEQ ID NO: 2597 - protein, 5 aa, Artificial sequence
  Synthetic peptide
AEVLG

SEQ ID NO: 2598 - protein, 5 aa, Artificial sequence
  Synthetic peptide
EVLGH

SEQ ID NO: 2599 - protein, 5 aa, Artificial sequence
  Synthetic peptide
VLGHK

SEQ ID NO: 2600 - protein, 5 aa, Artificial sequence
  Synthetic peptide
LGHKT

SEQ ID NO: 2601 - protein, 5 aa, Artificial sequence
  Synthetic peptide
GHKTP

SEQ ID NO: 2602 - protein, 5 aa, Artificial sequence
  Synthetic peptide
HKTPE

SEQ ID NO: 2603 - protein, 5 aa, Artificial sequence
  Synthetic peptide
KTPEP

SEQ ID NO: 2604 - protein, 5 aa, Artificial sequence
  Synthetic peptide
TPEPA

SEQ ID NO: 2605 - protein, 5 aa, Artificial sequence
  Synthetic peptide
PEPAP

SEQ ID NO: 2606 - protein, 5 aa, Artificial sequence
  Synthetic peptide
EPAPR

SEQ ID NO: 2607 - protein, 5 aa, Artificial sequence
  Synthetic peptide
PAPRR

SEQ ID NO: 2608 - protein, 5 aa, Artificial sequence
  Synthetic peptide
APRRT

SEQ ID NO: 2609 - protein, 5 aa, Artificial sequence
  Synthetic peptide
PRRTE

SEQ ID NO: 2610 - protein, 5 aa, Artificial sequence
  Synthetic peptide
RRTEI

SEQ ID NO: 2611 - protein, 5 aa, Artificial sequence
  Synthetic peptide
RTEIT

SEQ ID NO: 2612 - protein, 5 aa, Artificial sequence
  Synthetic peptide
TEITI

SEQ ID NO: 2613 - protein, 5 aa, Artificial sequence
  Synthetic peptide
EITIV

SEQ ID NO: 2614 - protein, 5 aa, Artificial sequence
  Synthetic peptide
ITIVK

SEQ ID NO: 2615 - protein, 5 aa, Artificial sequence
  Synthetic peptide
TIVKP

SEQ ID NO: 2616 - protein, 5 aa, Artificial sequence
  Synthetic peptide
IVKPQ

SEQ ID NO: 2617 - protein, 5 aa, Artificial sequence
  Synthetic peptide
VKPQE

SEQ ID NO: 2618 - protein, 5 aa, Artificial sequence
  Synthetic peptide
KPQES

SEQ ID NO: 2619 - protein, 5 aa, Artificial sequence
  Synthetic peptide
PQESA

SEQ ID NO: 2620 - protein, 5 aa, Artificial sequence
  Synthetic peptide
QESAH

SEQ ID NO: 2621 - protein, 5 aa, Artificial sequence
  Synthetic peptide
ESAHR

SEQ ID NO: 2622 - protein, 5 aa, Artificial sequence
  Synthetic peptide
SAHRR

SEQ ID NO: 2623 - protein, 5 aa, Artificial sequence
  Synthetic peptide
AHRRM

SEQ ID NO: 2624 - protein, 5 aa, Artificial sequence
  Synthetic peptide
HRRME

SEQ ID NO: 2625 - protein, 5 aa, Artificial sequence
  Synthetic peptide
RRMEP

SEQ ID NO: 2626 - protein, 5 aa, Artificial sequence
  Synthetic peptide
RMEPP

SEQ ID NO: 2627 - protein, 5 aa, Artificial sequence
  Synthetic peptide
MEPPA

SEQ ID NO: 2628 - protein, 5 aa, Artificial sequence
  Synthetic peptide
EPPAS

SEQ ID NO: 2629 - protein, 5 aa, Artificial sequence
  Synthetic peptide
PPASK

SEQ ID NO: 2630 - protein, 5 aa, Artificial sequence
  Synthetic peptide
PASKV

SEQ ID NO: 2631 - protein, 5 aa, Artificial sequence
  Synthetic peptide
ASKVP

SEQ ID NO: 2632 - protein, 5 aa, Artificial sequence
  Synthetic peptide
SKVPE

SEQ ID NO: 2633 - protein, 5 aa, Artificial sequence
  Synthetic peptide
KVPEV

SEQ ID NO: 2634 - protein, 5 aa, Artificial sequence
  Synthetic peptide
VPEVP

SEQ ID NO: 2635 - protein, 5 aa, Artificial sequence
  Synthetic peptide
PEVPT

SEQ ID NO: 2636 - protein, 5 aa, Artificial sequence
  Synthetic peptide
EVPTA

SEQ ID NO: 2637 - protein, 5 aa, Artificial sequence
  Synthetic peptide
VPTAP

SEQ ID NO: 2638 - protein, 5 aa, Artificial sequence
  Synthetic peptide
PTAPA

SEQ ID NO: 2639 - protein, 5 aa, Artificial sequence
  Synthetic peptide
TAPAT

SEQ ID NO: 2640 - protein, 5 aa, Artificial sequence
  Synthetic peptide
APATD

SEQ ID NO: 2641 - protein, 5 aa, Artificial sequence
  Synthetic peptide
PATDA

SEQ ID NO: 2642 - protein, 5 aa, Artificial sequence
  Synthetic peptide
ATDAA

SEQ ID NO: 2643 - protein, 5 aa, Artificial sequence
  Synthetic peptide
TDAAP

SEQ ID NO: 2644 - protein, 5 aa, Artificial sequence
  Synthetic peptide
DAAPK

SEQ ID NO: 2645 - protein, 5 aa, Artificial sequence
  Synthetic peptide
AAPKR

SEQ ID NO: 2646 - protein, 5 aa, Artificial sequence
  Synthetic peptide
APKRV

SEQ ID NO: 2647 - protein, 5 aa, Artificial sequence
  Synthetic peptide
PKRVE

SEQ ID NO: 2648 - protein, 5 aa, Artificial sequence
  Synthetic peptide
KRVEI

SEQ ID NO: 2649 - protein, 5 aa, Artificial sequence
  Synthetic peptide
RVEIQ

SEQ ID NO: 2650 - protein, 5 aa, Artificial sequence
  Synthetic peptide
VEIQM

SEQ ID NO: 2651 - protein, 5 aa, Artificial sequence
  Synthetic peptide
EIQMP

SEQ ID NO: 2652 - protein, 5 aa, Artificial sequence
  Synthetic peptide
IQMPK

SEQ ID NO: 2653 - protein, 5 aa, Artificial sequence
  Synthetic peptide
QMPKP

SEQ ID NO: 2654 - protein, 5 aa, Artificial sequence
  Synthetic peptide
MPKPA

SEQ ID NO: 2655 - protein, 5 aa, Artificial sequence
  Synthetic peptide
PKPAE

SEQ ID NO: 2656 - protein, 5 aa, Artificial sequence
  Synthetic peptide
KPAEA

SEQ ID NO: 2657 - protein, 5 aa, Artificial sequence
  Synthetic peptide
PAEAP

SEQ ID NO: 2658 - protein, 5 aa, Artificial sequence
  Synthetic peptide
AEAPT

SEQ ID NO: 2659 - protein, 5 aa, Artificial sequence
  Synthetic peptide
EAPTA

SEQ ID NO: 2660 - protein, 5 aa, Artificial sequence
  Synthetic peptide
APTAP

SEQ ID NO: 2661 - protein, 5 aa, Artificial sequence
  Synthetic peptide
PTAPS

SEQ ID NO: 2662 - protein, 5 aa, Artificial sequence
  Synthetic peptide
TAPSP

SEQ ID NO: 2663 - protein, 5 aa, Artificial sequence
  Synthetic peptide
APSPA

SEQ ID NO: 2664 - protein, 5 aa, Artificial sequence
  Synthetic peptide
PSPAQ

SEQ ID NO: 2665 - protein, 5 aa, Artificial sequence
  Synthetic peptide
SPAQT

SEQ ID NO: 2666 - protein, 5 aa, Artificial sequence
  Synthetic peptide
PAQTL

SEQ ID NO: 2667 - protein, 5 aa, Artificial sequence
  Synthetic peptide
AQTLE

SEQ ID NO: 2668 - protein, 5 aa, Artificial sequence
  Synthetic peptide
QTLEN

SEQ ID NO: 2669 - protein, 5 aa, Artificial sequence
  Synthetic peptide
TLENS

SEQ ID NO: 2670 - protein, 5 aa, Artificial sequence
  Synthetic peptide
LENSE

SEQ ID NO: 2671 - protein, 5 aa, Artificial sequence
  Synthetic peptide
ENSEP

SEQ ID NO: 2672 - protein, 5 aa, Artificial sequence
  Synthetic peptide
NSEPA

SEQ ID NO: 2673 - protein, 5 aa, Artificial sequence
  Synthetic peptide
SEPAP

SEQ ID NO: 2674 - protein, 5 aa, Artificial sequence
  Synthetic peptide
EPAPV

SEQ ID NO: 2675 - protein, 5 aa, Artificial sequence
  Synthetic peptide
PAPVS

SEQ ID NO: 2676 - protein, 5 aa, Artificial sequence
  Synthetic peptide
APVSQ

SEQ ID NO: 2677 - protein, 5 aa, Artificial sequence
  Synthetic peptide
PVSQL

SEQ ID NO: 2678 - protein, 5 aa, Artificial sequence
  Synthetic peptide
VSQLQ

SEQ ID NO: 2679 - protein, 5 aa, Artificial sequence
  Synthetic peptide
SQLQS

SEQ ID NO: 2680 - protein, 5 aa, Artificial sequence
  Synthetic peptide
QLQSR

SEQ ID NO: 2681 - protein, 5 aa, Artificial sequence
  Synthetic peptide
LQSRL

SEQ ID NO: 2682 - protein, 5 aa, Artificial sequence
  Synthetic peptide
QSRLE

SEQ ID NO: 2683 - protein, 5 aa, Artificial sequence
  Synthetic peptide
SRLEP

SEQ ID NO: 2684 - protein, 5 aa, Artificial sequence
  Synthetic peptide
RLEPK

SEQ ID NO: 2685 - protein, 5 aa, Artificial sequence
  Synthetic peptide
LEPKP

SEQ ID NO: 2686 - protein, 5 aa, Artificial sequence
  Synthetic peptide
EPKPQ

SEQ ID NO: 2687 - protein, 5 aa, Artificial sequence
  Synthetic peptide
PKPQP

SEQ ID NO: 2688 - protein, 5 aa, Artificial sequence
  Synthetic peptide
KPQPP

SEQ ID NO: 2689 - protein, 5 aa, Artificial sequence
  Synthetic peptide
PQPPV

SEQ ID NO: 2690 - protein, 5 aa, Artificial sequence
  Synthetic peptide
QPPVA

SEQ ID NO: 2691 - protein, 5 aa, Artificial sequence
  Synthetic peptide
PPVAE

SEQ ID NO: 2692 - protein, 5 aa, Artificial sequence
  Synthetic peptide
PVAEA

SEQ ID NO: 2693 - protein, 5 aa, Artificial sequence
  Synthetic peptide
VAEAT

SEQ ID NO: 2694 - protein, 5 aa, Artificial sequence
  Synthetic peptide
AEATP

SEQ ID NO: 2695 - protein, 5 aa, Artificial sequence
  Synthetic peptide
EATPR

SEQ ID NO: 2696 - protein, 5 aa, Artificial sequence
  Synthetic peptide
ATPRS

SEQ ID NO: 2697 - protein, 5 aa, Artificial sequence
  Synthetic peptide
TPRSQ

SEQ ID NO: 2698 - protein, 5 aa, Artificial sequence
  Synthetic peptide
PRSQE

SEQ ID NO: 2699 - protein, 5 aa, Artificial sequence
  Synthetic peptide
RSQEA

SEQ ID NO: 2700 - protein, 5 aa, Artificial sequence
  Synthetic peptide
SQEAT

SEQ ID NO: 2701 - protein, 5 aa, Artificial sequence
  Synthetic peptide
QEATE

SEQ ID NO: 2702 - protein, 5 aa, Artificial sequence
  Synthetic peptide
EATEA

SEQ ID NO: 2703 - protein, 5 aa, Artificial sequence
  Synthetic peptide
ATEAA

SEQ ID NO: 2704 - protein, 5 aa, Artificial sequence
  Synthetic peptide
TEAAP

SEQ ID NO: 2705 - protein, 5 aa, Artificial sequence
  Synthetic peptide
EAAPS

SEQ ID NO: 2706 - protein, 5 aa, Artificial sequence
  Synthetic peptide
AAPSC

SEQ ID NO: 2707 - protein, 5 aa, Artificial sequence
  Synthetic peptide
APSCV

SEQ ID NO: 2708 - protein, 5 aa, Artificial sequence
  Synthetic peptide
PSCVG

SEQ ID NO: 2709 - protein, 5 aa, Artificial sequence
  Synthetic peptide
SCVGD

SEQ ID NO: 2710 - protein, 5 aa, Artificial sequence
  Synthetic peptide
CVGDM

SEQ ID NO: 2711 - protein, 5 aa, Artificial sequence
  Synthetic peptide
VGDMA

SEQ ID NO: 2712 - protein, 5 aa, Artificial sequence
  Synthetic peptide
GDMAD

SEQ ID NO: 2713 - protein, 5 aa, Artificial sequence
  Synthetic peptide
DMADT

SEQ ID NO: 2714 - protein, 5 aa, Artificial sequence
  Synthetic peptide
MADTP

SEQ ID NO: 2715 - protein, 5 aa, Artificial sequence
  Synthetic peptide
ADTPR

SEQ ID NO: 2716 - protein, 5 aa, Artificial sequence
  Synthetic peptide
DTPRD

SEQ ID NO: 2717 - protein, 5 aa, Artificial sequence
  Synthetic peptide
TPRDA

SEQ ID NO: 2718 - protein, 5 aa, Artificial sequence
  Synthetic peptide
PRDAG

SEQ ID NO: 2719 - protein, 5 aa, Artificial sequence
  Synthetic peptide
RDAGL

SEQ ID NO: 2720 - protein, 5 aa, Artificial sequence
  Synthetic peptide
DAGLK

SEQ ID NO: 2721 - protein, 5 aa, Artificial sequence
  Synthetic peptide
AGLKQ

SEQ ID NO: 2722 - protein, 5 aa, Artificial sequence
  Synthetic peptide
GLKQA

SEQ ID NO: 2723 - protein, 5 aa, Artificial sequence
  Synthetic peptide
LKQAP

SEQ ID NO: 2724 - protein, 5 aa, Artificial sequence
  Synthetic peptide
KQAPA

SEQ ID NO: 2725 - protein, 5 aa, Artificial sequence
  Synthetic peptide
QAPAS

SEQ ID NO: 2726 - protein, 5 aa, Artificial sequence
  Synthetic peptide
APASR

SEQ ID NO: 2727 - protein, 5 aa, Artificial sequence
  Synthetic peptide
PASRN

SEQ ID NO: 2728 - protein, 5 aa, Artificial sequence
  Synthetic peptide
ASRNE

SEQ ID NO: 2729 - protein, 5 aa, Artificial sequence
  Synthetic peptide
SRNEK

SEQ ID NO: 2730 - protein, 5 aa, Artificial sequence
  Synthetic peptide
RNEKA

SEQ ID NO: 2731 - protein, 5 aa, Artificial sequence
  Synthetic peptide
NEKAP

SEQ ID NO: 2732 - protein, 5 aa, Artificial sequence
  Synthetic peptide
EKAPV

SEQ ID NO: 2733 - protein, 5 aa, Artificial sequence
  Synthetic peptide
KAPVD

SEQ ID NO: 2734 - protein, 5 aa, Artificial sequence
  Synthetic peptide
APVDF

SEQ ID NO: 2735 - protein, 5 aa, Artificial sequence
  Synthetic peptide
PVDFG

SEQ ID NO: 2736 - protein, 5 aa, Artificial sequence
  Synthetic peptide
VDFGY

SEQ ID NO: 2737 - protein, 5 aa, Artificial sequence
  Synthetic peptide
DFGYV

SEQ ID NO: 2738 - protein, 5 aa, Artificial sequence
  Synthetic peptide
FGYVG

SEQ ID NO: 2739 - protein, 5 aa, Artificial sequence
  Synthetic peptide
GYVGI

SEQ ID NO: 2740 - protein, 5 aa, Artificial sequence
  Synthetic peptide
YVGID

SEQ ID NO: 2741 - protein, 5 aa, Artificial sequence
  Synthetic peptide
VGIDS

SEQ ID NO: 2742 - protein, 5 aa, Artificial sequence
  Synthetic peptide
GIDSI

SEQ ID NO: 2743 - protein, 5 aa, Artificial sequence
  Synthetic peptide
IDSIL

SEQ ID NO: 2744 - protein, 5 aa, Artificial sequence
  Synthetic peptide
DSILE

SEQ ID NO: 2745 - protein, 5 aa, Artificial sequence
  Synthetic peptide
SILEQ

SEQ ID NO: 2746 - protein, 5 aa, Artificial sequence
  Synthetic peptide
ILEQM

SEQ ID NO: 2747 - protein, 5 aa, Artificial sequence
  Synthetic peptide
LEQMR

SEQ ID NO: 2748 - protein, 5 aa, Artificial sequence
  Synthetic peptide
EQMRR

SEQ ID NO: 2749 - protein, 5 aa, Artificial sequence
  Synthetic peptide
QMRRK

SEQ ID NO: 2750 - protein, 5 aa, Artificial sequence
  Synthetic peptide
MRRKA

SEQ ID NO: 2751 - protein, 5 aa, Artificial sequence
  Synthetic peptide
RRKAM

SEQ ID NO: 2752 - protein, 5 aa, Artificial sequence
  Synthetic peptide
RKAMK

SEQ ID NO: 2753 - protein, 5 aa, Artificial sequence
  Synthetic peptide
KAMKQ

SEQ ID NO: 2754 - protein, 5 aa, Artificial sequence
  Synthetic peptide
AMKQG

SEQ ID NO: 2755 - protein, 5 aa, Artificial sequence
  Synthetic peptide
MKQGF

SEQ ID NO: 2756 - protein, 5 aa, Artificial sequence
  Synthetic peptide
KQGFE

SEQ ID NO: 2757 - protein, 5 aa, Artificial sequence
  Synthetic peptide
QGFEF

SEQ ID NO: 2758 - protein, 5 aa, Artificial sequence
  Synthetic peptide
GFEFN

SEQ ID NO: 2759 - protein, 5 aa, Artificial sequence
  Synthetic peptide
FEFNI

SEQ ID NO: 2760 - protein, 5 aa, Artificial sequence
  Synthetic peptide
EFNIM

SEQ ID NO: 2761 - protein, 5 aa, Artificial sequence
  Synthetic peptide
FNIMV

SEQ ID NO: 2762 - protein, 5 aa, Artificial sequence
  Synthetic peptide
NIMVV

SEQ ID NO: 2763 - protein, 5 aa, Artificial sequence
  Synthetic peptide
IMVVG

SEQ ID NO: 2764 - protein, 5 aa, Artificial sequence
  Synthetic peptide
MVVGQ

SEQ ID NO: 2765 - protein, 5 aa, Artificial sequence
  Synthetic peptide
VVGQS

SEQ ID NO: 2766 - protein, 5 aa, Artificial sequence
  Synthetic peptide
VGQSG

SEQ ID NO: 2767 - protein, 5 aa, Artificial sequence
  Synthetic peptide
GQSGL

SEQ ID NO: 2768 - protein, 5 aa, Artificial sequence
  Synthetic peptide
QSGLG

SEQ ID NO: 2769 - protein, 5 aa, Artificial sequence
  Synthetic peptide
SGLGK

SEQ ID NO: 2770 - protein, 5 aa, Artificial sequence
  Synthetic peptide
GLGKS

SEQ ID NO: 2771 - protein, 5 aa, Artificial sequence
  Synthetic peptide
LGKST

SEQ ID NO: 2772 - protein, 5 aa, Artificial sequence
  Synthetic peptide
GKSTL

SEQ ID NO: 2773 - protein, 5 aa, Artificial sequence
  Synthetic peptide
KSTLI

SEQ ID NO: 2774 - protein, 5 aa, Artificial sequence
  Synthetic peptide
STLIN

SEQ ID NO: 2775 - protein, 5 aa, Artificial sequence
  Synthetic peptide
TLINT

SEQ ID NO: 2776 - protein, 5 aa, Artificial sequence
  Synthetic peptide
LINTL

SEQ ID NO: 2777 - protein, 5 aa, Artificial sequence
  Synthetic peptide
INTLF

SEQ ID NO: 2778 - protein, 5 aa, Artificial sequence
  Synthetic peptide
NTLFK

SEQ ID NO: 2779 - protein, 5 aa, Artificial sequence
  Synthetic peptide
TLFKS

SEQ ID NO: 2780 - protein, 5 aa, Artificial sequence
  Synthetic peptide
LFKSK

SEQ ID NO: 2781 - protein, 5 aa, Artificial sequence
  Synthetic peptide
FKSKI

SEQ ID NO: 2782 - protein, 5 aa, Artificial sequence
  Synthetic peptide
KSKIS

SEQ ID NO: 2783 - protein, 5 aa, Artificial sequence
  Synthetic peptide
SKISR

SEQ ID NO: 2784 - protein, 5 aa, Artificial sequence
  Synthetic peptide
KISRK

SEQ ID NO: 2785 - protein, 5 aa, Artificial sequence
  Synthetic peptide
ISRKS

SEQ ID NO: 2786 - protein, 5 aa, Artificial sequence
  Synthetic peptide
SRKSV

SEQ ID NO: 2787 - protein, 5 aa, Artificial sequence
  Synthetic peptide
RKSVQ

SEQ ID NO: 2788 - protein, 5 aa, Artificial sequence
  Synthetic peptide
KSVQP

SEQ ID NO: 2789 - protein, 5 aa, Artificial sequence
  Synthetic peptide
SVQPT

SEQ ID NO: 2790 - protein, 5 aa, Artificial sequence
  Synthetic peptide
VQPTS

SEQ ID NO: 2791 - protein, 5 aa, Artificial sequence
  Synthetic peptide
QPTSE

SEQ ID NO: 2792 - protein, 5 aa, Artificial sequence
  Synthetic peptide
PTSEE

SEQ ID NO: 2793 - protein, 5 aa, Artificial sequence
  Synthetic peptide
TSEER

SEQ ID NO: 2794 - protein, 5 aa, Artificial sequence
  Synthetic peptide
SEERI

SEQ ID NO: 2795 - protein, 5 aa, Artificial sequence
  Synthetic peptide
EERIP

SEQ ID NO: 2796 - protein, 5 aa, Artificial sequence
  Synthetic peptide
ERIPK

SEQ ID NO: 2797 - protein, 5 aa, Artificial sequence
  Synthetic peptide
RIPKT

SEQ ID NO: 2798 - protein, 5 aa, Artificial sequence
  Synthetic peptide
IPKTI

SEQ ID NO: 2799 - protein, 5 aa, Artificial sequence
  Synthetic peptide
PKTIE

SEQ ID NO: 2800 - protein, 5 aa, Artificial sequence
  Synthetic peptide
KTIEI

SEQ ID NO: 2801 - protein, 5 aa, Artificial sequence
  Synthetic peptide
TIEIK

SEQ ID NO: 2802 - protein, 5 aa, Artificial sequence
  Synthetic peptide
IEIKS

SEQ ID NO: 2803 - protein, 5 aa, Artificial sequence
  Synthetic peptide
EIKSI

SEQ ID NO: 2804 - protein, 5 aa, Artificial sequence
  Synthetic peptide
IKSIT

SEQ ID NO: 2805 - protein, 5 aa, Artificial sequence
  Synthetic peptide
KSITH

SEQ ID NO: 2806 - protein, 5 aa, Artificial sequence
  Synthetic peptide
SITHD

SEQ ID NO: 2807 - protein, 5 aa, Artificial sequence
  Synthetic peptide
ITHDI

SEQ ID NO: 2808 - protein, 5 aa, Artificial sequence
  Synthetic peptide
THDIE

SEQ ID NO: 2809 - protein, 5 aa, Artificial sequence
  Synthetic peptide
HDIEE

SEQ ID NO: 2810 - protein, 5 aa, Artificial sequence
  Synthetic peptide
DIEEK

SEQ ID NO: 2811 - protein, 5 aa, Artificial sequence
  Synthetic peptide
IEEKG

SEQ ID NO: 2812 - protein, 5 aa, Artificial sequence
  Synthetic peptide
EEKGV

SEQ ID NO: 2813 - protein, 5 aa, Artificial sequence
  Synthetic peptide
EKGVR

SEQ ID NO: 2814 - protein, 5 aa, Artificial sequence
  Synthetic peptide
KGVRM

SEQ ID NO: 2815 - protein, 5 aa, Artificial sequence
  Synthetic peptide
GVRMK

SEQ ID NO: 2816 - protein, 5 aa, Artificial sequence
  Synthetic peptide
VRMKL

SEQ ID NO: 2817 - protein, 5 aa, Artificial sequence
  Synthetic peptide
RMKLT

SEQ ID NO: 2818 - protein, 5 aa, Artificial sequence
  Synthetic peptide
MKLTV

SEQ ID NO: 2819 - protein, 5 aa, Artificial sequence
  Synthetic peptide
KLTVI

SEQ ID NO: 2820 - protein, 5 aa, Artificial sequence
  Synthetic peptide
LTVID

SEQ ID NO: 2821 - protein, 5 aa, Artificial sequence
  Synthetic peptide
TVIDT

SEQ ID NO: 2822 - protein, 5 aa, Artificial sequence
  Synthetic peptide
VIDTP

SEQ ID NO: 2823 - protein, 5 aa, Artificial sequence
  Synthetic peptide
IDTPG

SEQ ID NO: 2824 - protein, 5 aa, Artificial sequence
  Synthetic peptide
DTPGF

SEQ ID NO: 2825 - protein, 5 aa, Artificial sequence
  Synthetic peptide
TPGFG

SEQ ID NO: 2826 - protein, 5 aa, Artificial sequence
  Synthetic peptide
PGFGD

SEQ ID NO: 2827 - protein, 5 aa, Artificial sequence
  Synthetic peptide
GFGDH

SEQ ID NO: 2828 - protein, 5 aa, Artificial sequence
  Synthetic peptide
FGDHI

SEQ ID NO: 2829 - protein, 5 aa, Artificial sequence
  Synthetic peptide
GDHIN

SEQ ID NO: 2830 - protein, 5 aa, Artificial sequence
  Synthetic peptide
DHINN

SEQ ID NO: 2831 - protein, 5 aa, Artificial sequence
  Synthetic peptide
HINNE

SEQ ID NO: 2832 - protein, 5 aa, Artificial sequence
  Synthetic peptide
INNEN

SEQ ID NO: 2833 - protein, 5 aa, Artificial sequence
  Synthetic peptide
NNENC

SEQ ID NO: 2834 - protein, 5 aa, Artificial sequence
  Synthetic peptide
NENCW

SEQ ID NO: 2835 - protein, 5 aa, Artificial sequence
  Synthetic peptide
ENCWQ

SEQ ID NO: 2836 - protein, 5 aa, Artificial sequence
  Synthetic peptide
NCWQP

SEQ ID NO: 2837 - protein, 5 aa, Artificial sequence
  Synthetic peptide
CWQPI

SEQ ID NO: 2838 - protein, 5 aa, Artificial sequence
  Synthetic peptide
WQPIM

SEQ ID NO: 2839 - protein, 5 aa, Artificial sequence
  Synthetic peptide
QPIMK

SEQ ID NO: 2840 - protein, 5 aa, Artificial sequence
  Synthetic peptide
PIMKF

SEQ ID NO: 2841 - protein, 5 aa, Artificial sequence
  Synthetic peptide
IMKFI

SEQ ID NO: 2842 - protein, 5 aa, Artificial sequence
  Synthetic peptide
MKFIN

SEQ ID NO: 2843 - protein, 5 aa, Artificial sequence
  Synthetic peptide
KFIND

SEQ ID NO: 2844 - protein, 5 aa, Artificial sequence
  Synthetic peptide
FINDQ

SEQ ID NO: 2845 - protein, 5 aa, Artificial sequence
  Synthetic peptide
INDQY

SEQ ID NO: 2846 - protein, 5 aa, Artificial sequence
  Synthetic peptide
NDQYE

SEQ ID NO: 2847 - protein, 5 aa, Artificial sequence
  Synthetic peptide
DQYEK

SEQ ID NO: 2848 - protein, 5 aa, Artificial sequence
  Synthetic peptide
QYEKY

SEQ ID NO: 2849 - protein, 5 aa, Artificial sequence
  Synthetic peptide
YEKYL

SEQ ID NO: 2850 - protein, 5 aa, Artificial sequence
  Synthetic peptide
EKYLQ

SEQ ID NO: 2851 - protein, 5 aa, Artificial sequence
  Synthetic peptide
KYLQE

SEQ ID NO: 2852 - protein, 5 aa, Artificial sequence
  Synthetic peptide
YLQEE

SEQ ID NO: 2853 - protein, 5 aa, Artificial sequence
  Synthetic peptide
LQEEV

SEQ ID NO: 2854 - protein, 5 aa, Artificial sequence
  Synthetic peptide
QEEVN

SEQ ID NO: 2855 - protein, 5 aa, Artificial sequence
  Synthetic peptide
EEVNI

SEQ ID NO: 2856 - protein, 5 aa, Artificial sequence
  Synthetic peptide
EVNIN

SEQ ID NO: 2857 - protein, 5 aa, Artificial sequence
  Synthetic peptide
VNINR

SEQ ID NO: 2858 - protein, 5 aa, Artificial sequence
  Synthetic peptide
NINRK

SEQ ID NO: 2859 - protein, 5 aa, Artificial sequence
  Synthetic peptide
INRKK

SEQ ID NO: 2860 - protein, 5 aa, Artificial sequence
  Synthetic peptide
NRKKR

SEQ ID NO: 2861 - protein, 5 aa, Artificial sequence
  Synthetic peptide
RKKRI

SEQ ID NO: 2862 - protein, 5 aa, Artificial sequence
  Synthetic peptide
KKRIP

SEQ ID NO: 2863 - protein, 5 aa, Artificial sequence
  Synthetic peptide
KRIPD

SEQ ID NO: 2864 - protein, 5 aa, Artificial sequence
  Synthetic peptide
RIPDT

SEQ ID NO: 2865 - protein, 5 aa, Artificial sequence
  Synthetic peptide
IPDTR

SEQ ID NO: 2866 - protein, 5 aa, Artificial sequence
  Synthetic peptide
PDTRV

SEQ ID NO: 2867 - protein, 5 aa, Artificial sequence
  Synthetic peptide
DTRVH

SEQ ID NO: 2868 - protein, 5 aa, Artificial sequence
  Synthetic peptide
TRVHC

SEQ ID NO: 2869 - protein, 5 aa, Artificial sequence
  Synthetic peptide
RVHCC

SEQ ID NO: 2870 - protein, 5 aa, Artificial sequence
  Synthetic peptide
VHCCL

SEQ ID NO: 2871 - protein, 5 aa, Artificial sequence
  Synthetic peptide
HCCLY

SEQ ID NO: 2872 - protein, 5 aa, Artificial sequence
  Synthetic peptide
CCLYF

SEQ ID NO: 2873 - protein, 5 aa, Artificial sequence
  Synthetic peptide
CLYFI

SEQ ID NO: 2874 - protein, 5 aa, Artificial sequence
  Synthetic peptide
LYFIP

SEQ ID NO: 2875 - protein, 5 aa, Artificial sequence
  Synthetic peptide
YFIPA

SEQ ID NO: 2876 - protein, 5 aa, Artificial sequence
  Synthetic peptide
FIPAT

SEQ ID NO: 2877 - protein, 5 aa, Artificial sequence
  Synthetic peptide
IPATG

SEQ ID NO: 2878 - protein, 5 aa, Artificial sequence
  Synthetic peptide
PATGH

SEQ ID NO: 2879 - protein, 5 aa, Artificial sequence
  Synthetic peptide
ATGHS

SEQ ID NO: 2880 - protein, 5 aa, Artificial sequence
  Synthetic peptide
TGHSL

SEQ ID NO: 2881 - protein, 5 aa, Artificial sequence
  Synthetic peptide
GHSLR

SEQ ID NO: 2882 - protein, 5 aa, Artificial sequence
  Synthetic peptide
HSLRP

SEQ ID NO: 2883 - protein, 5 aa, Artificial sequence
  Synthetic peptide
SLRPL

SEQ ID NO: 2884 - protein, 5 aa, Artificial sequence
  Synthetic peptide
LRPLD

SEQ ID NO: 2885 - protein, 5 aa, Artificial sequence
  Synthetic peptide
RPLDI

SEQ ID NO: 2886 - protein, 5 aa, Artificial sequence
  Synthetic peptide
PLDIE

SEQ ID NO: 2887 - protein, 5 aa, Artificial sequence
  Synthetic peptide
LDIEF

SEQ ID NO: 2888 - protein, 5 aa, Artificial sequence
  Synthetic peptide
DIEFM

SEQ ID NO: 2889 - protein, 5 aa, Artificial sequence
  Synthetic peptide
IEFMK

SEQ ID NO: 2890 - protein, 5 aa, Artificial sequence
  Synthetic peptide
EFMKR

SEQ ID NO: 2891 - protein, 5 aa, Artificial sequence
  Synthetic peptide
FMKRL

SEQ ID NO: 2892 - protein, 5 aa, Artificial sequence
  Synthetic peptide
MKRLS

SEQ ID NO: 2893 - protein, 5 aa, Artificial sequence
  Synthetic peptide
KRLSK

SEQ ID NO: 2894 - protein, 5 aa, Artificial sequence
  Synthetic peptide
RLSKV

SEQ ID NO: 2895 - protein, 5 aa, Artificial sequence
  Synthetic peptide
LSKVV

SEQ ID NO: 2896 - protein, 5 aa, Artificial sequence
  Synthetic peptide
SKVVN

SEQ ID NO: 2897 - protein, 5 aa, Artificial sequence
  Synthetic peptide
KVVNI

SEQ ID NO: 2898 - protein, 5 aa, Artificial sequence
  Synthetic peptide
VVNIV

SEQ ID NO: 2899 - protein, 5 aa, Artificial sequence
  Synthetic peptide
VNIVP

SEQ ID NO: 2900 - protein, 5 aa, Artificial sequence
  Synthetic peptide
NIVPV

SEQ ID NO: 2901 - protein, 5 aa, Artificial sequence
  Synthetic peptide
IVPVI

SEQ ID NO: 2902 - protein, 5 aa, Artificial sequence
  Synthetic peptide
VPVIA

SEQ ID NO: 2903 - protein, 5 aa, Artificial sequence
  Synthetic peptide
PVIAK

SEQ ID NO: 2904 - protein, 5 aa, Artificial sequence
  Synthetic peptide
VIAKA

SEQ ID NO: 2905 - protein, 5 aa, Artificial sequence
  Synthetic peptide
IAKAD

SEQ ID NO: 2906 - protein, 5 aa, Artificial sequence
  Synthetic peptide
AKADT

SEQ ID NO: 2907 - protein, 5 aa, Artificial sequence
  Synthetic peptide
KADTL

SEQ ID NO: 2908 - protein, 5 aa, Artificial sequence
  Synthetic peptide
ADTLT

SEQ ID NO: 2909 - protein, 5 aa, Artificial sequence
  Synthetic peptide
DTLTL

SEQ ID NO: 2910 - protein, 5 aa, Artificial sequence
  Synthetic peptide
TLTLE

SEQ ID NO: 2911 - protein, 5 aa, Artificial sequence
  Synthetic peptide
LTLEE

SEQ ID NO: 2912 - protein, 5 aa, Artificial sequence
  Synthetic peptide
TLEER

SEQ ID NO: 2913 - protein, 5 aa, Artificial sequence
  Synthetic peptide
LEERV

SEQ ID NO: 2914 - protein, 5 aa, Artificial sequence
  Synthetic peptide
EERVH

SEQ ID NO: 2915 - protein, 5 aa, Artificial sequence
  Synthetic peptide
ERVHF

SEQ ID NO: 2916 - protein, 5 aa, Artificial sequence
  Synthetic peptide
RVHFK

SEQ ID NO: 2917 - protein, 5 aa, Artificial sequence
  Synthetic peptide
VHFKQ

SEQ ID NO: 2918 - protein, 5 aa, Artificial sequence
  Synthetic peptide
HFKQR

SEQ ID NO: 2919 - protein, 5 aa, Artificial sequence
  Synthetic peptide
FKQRI

SEQ ID NO: 2920 - protein, 5 aa, Artificial sequence
  Synthetic peptide
KQRIT

SEQ ID NO: 2921 - protein, 5 aa, Artificial sequence
  Synthetic peptide
QRITA

SEQ ID NO: 2922 - protein, 5 aa, Artificial sequence
  Synthetic peptide
RITAD

SEQ ID NO: 2923 - protein, 5 aa, Artificial sequence
  Synthetic peptide
ITADL

SEQ ID NO: 2924 - protein, 5 aa, Artificial sequence
  Synthetic peptide
TADLL

SEQ ID NO: 2925 - protein, 5 aa, Artificial sequence
  Synthetic peptide
ADLLS

SEQ ID NO: 2926 - protein, 5 aa, Artificial sequence
  Synthetic peptide
DLLSN

SEQ ID NO: 2927 - protein, 5 aa, Artificial sequence
  Synthetic peptide
LLSNG

SEQ ID NO: 2928 - protein, 5 aa, Artificial sequence
  Synthetic peptide
LSNGI

SEQ ID NO: 2929 - protein, 5 aa, Artificial sequence
  Synthetic peptide
SNGID

SEQ ID NO: 2930 - protein, 5 aa, Artificial sequence
  Synthetic peptide
NGIDV

SEQ ID NO: 2931 - protein, 5 aa, Artificial sequence
  Synthetic peptide
GIDVY

SEQ ID NO: 2932 - protein, 5 aa, Artificial sequence
  Synthetic peptide
IDVYP

SEQ ID NO: 2933 - protein, 5 aa, Artificial sequence
  Synthetic peptide
DVYPQ

SEQ ID NO: 2934 - protein, 5 aa, Artificial sequence
  Synthetic peptide
VYPQK

SEQ ID NO: 2935 - protein, 5 aa, Artificial sequence
  Synthetic peptide
YPQKE

SEQ ID NO: 2936 - protein, 5 aa, Artificial sequence
  Synthetic peptide
PQKEF

SEQ ID NO: 2937 - protein, 5 aa, Artificial sequence
  Synthetic peptide
QKEFD

SEQ ID NO: 2938 - protein, 5 aa, Artificial sequence
  Synthetic peptide
KEFDE

SEQ ID NO: 2939 - protein, 5 aa, Artificial sequence
  Synthetic peptide
EFDED

SEQ ID NO: 2940 - protein, 5 aa, Artificial sequence
  Synthetic peptide
FDEDS

SEQ ID NO: 2941 - protein, 5 aa, Artificial sequence
  Synthetic peptide
DEDSE

SEQ ID NO: 2942 - protein, 5 aa, Artificial sequence
  Synthetic peptide
EDSED

SEQ ID NO: 2943 - protein, 5 aa, Artificial sequence
  Synthetic peptide
DSEDR

SEQ ID NO: 2944 - protein, 5 aa, Artificial sequence
  Synthetic peptide
SEDRL

SEQ ID NO: 2945 - protein, 5 aa, Artificial sequence
  Synthetic peptide
EDRLV

SEQ ID NO: 2946 - protein, 5 aa, Artificial sequence
  Synthetic peptide
DRLVN

SEQ ID NO: 2947 - protein, 5 aa, Artificial sequence
  Synthetic peptide
RLVNE

SEQ ID NO: 2948 - protein, 5 aa, Artificial sequence
  Synthetic peptide
LVNEK

SEQ ID NO: 2949 - protein, 5 aa, Artificial sequence
  Synthetic peptide
VNEKF

SEQ ID NO: 2950 - protein, 5 aa, Artificial sequence
  Synthetic peptide
NEKFR

SEQ ID NO: 2951 - protein, 5 aa, Artificial sequence
  Synthetic peptide
EKFRE

SEQ ID NO: 2952 - protein, 5 aa, Artificial sequence
  Synthetic peptide
KFREM

SEQ ID NO: 2953 - protein, 5 aa, Artificial sequence
  Synthetic peptide
FREMI

SEQ ID NO: 2954 - protein, 5 aa, Artificial sequence
  Synthetic peptide
REMIP

SEQ ID NO: 2955 - protein, 5 aa, Artificial sequence
  Synthetic peptide
EMIPF

SEQ ID NO: 2956 - protein, 5 aa, Artificial sequence
  Synthetic peptide
MIPFA

SEQ ID NO: 2957 - protein, 5 aa, Artificial sequence
  Synthetic peptide
IPFAV

SEQ ID NO: 2958 - protein, 5 aa, Artificial sequence
  Synthetic peptide
PFAVV

SEQ ID NO: 2959 - protein, 5 aa, Artificial sequence
  Synthetic peptide
FAVVG

SEQ ID NO: 2960 - protein, 5 aa, Artificial sequence
  Synthetic peptide
AVVGS

SEQ ID NO: 2961 - protein, 5 aa, Artificial sequence
  Synthetic peptide
VVGSD

SEQ ID NO: 2962 - protein, 5 aa, Artificial sequence
  Synthetic peptide
VGSDH

SEQ ID NO: 2963 - protein, 5 aa, Artificial sequence
  Synthetic peptide
GSDHE

SEQ ID NO: 2964 - protein, 5 aa, Artificial sequence
  Synthetic peptide
SDHEY

SEQ ID NO: 2965 - protein, 5 aa, Artificial sequence
  Synthetic peptide
DHEYQ

SEQ ID NO: 2966 - protein, 5 aa, Artificial sequence
  Synthetic peptide
HEYQV

SEQ ID NO: 2967 - protein, 5 aa, Artificial sequence
  Synthetic peptide
EYQVN

SEQ ID NO: 2968 - protein, 5 aa, Artificial sequence
  Synthetic peptide
YQVNG

SEQ ID NO: 2969 - protein, 5 aa, Artificial sequence
  Synthetic peptide
QVNGK

SEQ ID NO: 2970 - protein, 5 aa, Artificial sequence
  Synthetic peptide
VNGKR

SEQ ID NO: 2971 - protein, 5 aa, Artificial sequence
  Synthetic peptide
NGKRI

SEQ ID NO: 2972 - protein, 5 aa, Artificial sequence
  Synthetic peptide
GKRIL

SEQ ID NO: 2973 - protein, 5 aa, Artificial sequence
  Synthetic peptide
KRILG

SEQ ID NO: 2974 - protein, 5 aa, Artificial sequence
  Synthetic peptide
RILGR

SEQ ID NO: 2975 - protein, 5 aa, Artificial sequence
  Synthetic peptide
ILGRK

SEQ ID NO: 2976 - protein, 5 aa, Artificial sequence
  Synthetic peptide
LGRKT

SEQ ID NO: 2977 - protein, 5 aa, Artificial sequence
  Synthetic peptide
GRKTK

SEQ ID NO: 2978 - protein, 5 aa, Artificial sequence
  Synthetic peptide
RKTKW

SEQ ID NO: 2979 - protein, 5 aa, Artificial sequence
  Synthetic peptide
KTKWG

SEQ ID NO: 2980 - protein, 5 aa, Artificial sequence
  Synthetic peptide
TKWGT

SEQ ID NO: 2981 - protein, 5 aa, Artificial sequence
  Synthetic peptide
KWGTI

SEQ ID NO: 2982 - protein, 5 aa, Artificial sequence
  Synthetic peptide
WGTIE

SEQ ID NO: 2983 - protein, 5 aa, Artificial sequence
  Synthetic peptide
GTIEV

SEQ ID NO: 2984 - protein, 5 aa, Artificial sequence
  Synthetic peptide
TIEVE

SEQ ID NO: 2985 - protein, 5 aa, Artificial sequence
  Synthetic peptide
IEVEN

SEQ ID NO: 2986 - protein, 5 aa, Artificial sequence
  Synthetic peptide
EVENT

SEQ ID NO: 2987 - protein, 5 aa, Artificial sequence
  Synthetic peptide
VENTT

SEQ ID NO: 2988 - protein, 5 aa, Artificial sequence
  Synthetic peptide
ENTTH

SEQ ID NO: 2989 - protein, 5 aa, Artificial sequence
  Synthetic peptide
NTTHC

SEQ ID NO: 2990 - protein, 5 aa, Artificial sequence
  Synthetic peptide
TTHCE

SEQ ID NO: 2991 - protein, 5 aa, Artificial sequence
  Synthetic peptide
THCEF

SEQ ID NO: 2992 - protein, 5 aa, Artificial sequence
  Synthetic peptide
HCEFA

SEQ ID NO: 2993 - protein, 5 aa, Artificial sequence
  Synthetic peptide
CEFAY

SEQ ID NO: 2994 - protein, 5 aa, Artificial sequence
  Synthetic peptide
EFAYL

SEQ ID NO: 2995 - protein, 5 aa, Artificial sequence
  Synthetic peptide
FAYLR

SEQ ID NO: 2996 - protein, 5 aa, Artificial sequence
  Synthetic peptide
AYLRD

SEQ ID NO: 2997 - protein, 5 aa, Artificial sequence
  Synthetic peptide
YLRDL

SEQ ID NO: 2998 - protein, 5 aa, Artificial sequence
  Synthetic peptide
LRDLL

SEQ ID NO: 2999 - protein, 5 aa, Artificial sequence
  Synthetic peptide
RDLLI

SEQ ID NO: 3000 - protein, 5 aa, Artificial sequence
  Synthetic peptide
DLLIR

SEQ ID NO: 3001 - protein, 5 aa, Artificial sequence
  Synthetic peptide
LLIRT

SEQ ID NO: 3002 - protein, 5 aa, Artificial sequence
  Synthetic peptide
LIRTH

SEQ ID NO: 3003 - protein, 5 aa, Artificial sequence
  Synthetic peptide
IRTHM

SEQ ID NO: 3004 - protein, 5 aa, Artificial sequence
  Synthetic peptide
RTHMQ

SEQ ID NO: 3005 - protein, 5 aa, Artificial sequence
  Synthetic peptide
THMQN

SEQ ID NO: 3006 - protein, 5 aa, Artificial sequence
  Synthetic peptide
HMQNI

SEQ ID NO: 3007 - protein, 5 aa, Artificial sequence
  Synthetic peptide
MQNIK

SEQ ID NO: 3008 - protein, 5 aa, Artificial sequence
  Synthetic peptide
QNIKD

SEQ ID NO: 3009 - protein, 5 aa, Artificial sequence
  Synthetic peptide
NIKDI

SEQ ID NO: 3010 - protein, 5 aa, Artificial sequence
  Synthetic peptide
IKDIT

SEQ ID NO: 3011 - protein, 5 aa, Artificial sequence
  Synthetic peptide
KDITS

SEQ ID NO: 3012 - protein, 5 aa, Artificial sequence
  Synthetic peptide
DITSS

SEQ ID NO: 3013 - protein, 5 aa, Artificial sequence
  Synthetic peptide
ITSSI

SEQ ID NO: 3014 - protein, 5 aa, Artificial sequence
  Synthetic peptide
TSSIH

SEQ ID NO: 3015 - protein, 5 aa, Artificial sequence
  Synthetic peptide
SSIHF

SEQ ID NO: 3016 - protein, 5 aa, Artificial sequence
  Synthetic peptide
SIHFE

SEQ ID NO: 3017 - protein, 5 aa, Artificial sequence
  Synthetic peptide
IHFEA

SEQ ID NO: 3018 - protein, 5 aa, Artificial sequence
  Synthetic peptide
HFEAY

SEQ ID NO: 3019 - protein, 5 aa, Artificial sequence
  Synthetic peptide
FEAYR

SEQ ID NO: 3020 - protein, 5 aa, Artificial sequence
  Synthetic peptide
EAYRV

SEQ ID NO: 3021 - protein, 5 aa, Artificial sequence
  Synthetic peptide
AYRVK

SEQ ID NO: 3022 - protein, 5 aa, Artificial sequence
  Synthetic peptide
YRVKR

SEQ ID NO: 3023 - protein, 5 aa, Artificial sequence
  Synthetic peptide
RVKRL

SEQ ID NO: 3024 - protein, 5 aa, Artificial sequence
  Synthetic peptide
VKRLN

SEQ ID NO: 3025 - protein, 5 aa, Artificial sequence
  Synthetic peptide
KRLNE

SEQ ID NO: 3026 - protein, 5 aa, Artificial sequence
  Synthetic peptide
RLNEG

SEQ ID NO: 3027 - protein, 5 aa, Artificial sequence
  Synthetic peptide
LNEGS

SEQ ID NO: 3028 - protein, 5 aa, Artificial sequence
  Synthetic peptide
NEGSS

SEQ ID NO: 3029 - protein, 5 aa, Artificial sequence
  Synthetic peptide
EGSSA

SEQ ID NO: 3030 - protein, 5 aa, Artificial sequence
  Synthetic peptide
GSSAM

SEQ ID NO: 3031 - protein, 5 aa, Artificial sequence
  Synthetic peptide
SSAMA

SEQ ID NO: 3032 - protein, 5 aa, Artificial sequence
  Synthetic peptide
SAMAN

SEQ ID NO: 3033 - protein, 5 aa, Artificial sequence
  Synthetic peptide
AMANG

SEQ ID NO: 3034 - protein, 5 aa, Artificial sequence
  Synthetic peptide
MANGV

SEQ ID NO: 3035 - protein, 5 aa, Artificial sequence
  Synthetic peptide
ANGVE

SEQ ID NO: 3036 - protein, 5 aa, Artificial sequence
  Synthetic peptide
NGVEE

SEQ ID NO: 3037 - protein, 5 aa, Artificial sequence
  Synthetic peptide
GVEEK

SEQ ID NO: 3038 - protein, 5 aa, Artificial sequence
  Synthetic peptide
VEEKE

SEQ ID NO: 3039 - protein, 5 aa, Artificial sequence
  Synthetic peptide
EEKEP

SEQ ID NO: 3040 - protein, 5 aa, Artificial sequence
  Synthetic peptide
EKEPE

SEQ ID NO: 3041 - protein, 5 aa, Artificial sequence
  Synthetic peptide
KEPEA

SEQ ID NO: 3042 - protein, 5 aa, Artificial sequence
  Synthetic peptide
EPEAP

SEQ ID NO: 3043 - protein, 5 aa, Artificial sequence
  Synthetic peptide
PEAPE

SEQ ID NO: 3044 - protein, 5 aa, Artificial sequence
  Synthetic peptide
EAPEM

SEQ ID NO: 3045 - protein, 10 aa, Artificial sequence
  Synthetic peptide
MKKSYSGGTR

SEQ ID NO: 3046 - protein, 10 aa, Artificial sequence
  Synthetic peptide
KKSYSGGTRT

SEQ ID NO: 3047 - protein, 10 aa, Artificial sequence
  Synthetic peptide
KSYSGGTRTS

SEQ ID NO: 3048 - protein, 10 aa, Artificial sequence
  Synthetic peptide
SYSGGTRTSS

SEQ ID NO: 3049 - protein, 10 aa, Artificial sequence
  Synthetic peptide
YSGGTRTSSG

SEQ ID NO: 3050 - protein, 10 aa, Artificial sequence
  Synthetic peptide
SGGTRTSSGR

SEQ ID NO: 3051 - protein, 10 aa, Artificial sequence
  Synthetic peptide
GGTRTSSGRL

SEQ ID NO: 3052 - protein, 10 aa, Artificial sequence
  Synthetic peptide
GTRTSSGRLR

SEQ ID NO: 3053 - protein, 10 aa, Artificial sequence
  Synthetic peptide
TRTSSGRLRR

SEQ ID NO: 3054 - protein, 10 aa, Artificial sequence
  Synthetic peptide
RTSSGRLRRL

SEQ ID NO: 3055 - protein, 10 aa, Artificial sequence
  Synthetic peptide
TSSGRLRRLG

SEQ ID NO: 3056 - protein, 10 aa, Artificial sequence
  Synthetic peptide
SSGRLRRLGD

SEQ ID NO: 3057 - protein, 10 aa, Artificial sequence
  Synthetic peptide
SGRLRRLGDS

SEQ ID NO: 3058 - protein, 10 aa, Artificial sequence
  Synthetic peptide
GRLRRLGDSS

SEQ ID NO: 3059 - protein, 10 aa, Artificial sequence
  Synthetic peptide
RLRRLGDSSG

SEQ ID NO: 3060 - protein, 10 aa, Artificial sequence
  Synthetic peptide
LRRLGDSSGP

SEQ ID NO: 3061 - protein, 10 aa, Artificial sequence
  Synthetic peptide
RRLGDSSGPA

SEQ ID NO: 3062 - protein, 10 aa, Artificial sequence
  Synthetic peptide
RLGDSSGPAL

SEQ ID NO: 3063 - protein, 10 aa, Artificial sequence
  Synthetic peptide
LGDSSGPALK

SEQ ID NO: 3064 - protein, 10 aa, Artificial sequence
  Synthetic peptide
GDSSGPALKR

SEQ ID NO: 3065 - protein, 10 aa, Artificial sequence
  Synthetic peptide
DSSGPALKRS

SEQ ID NO: 3066 - protein, 10 aa, Artificial sequence
  Synthetic peptide
SSGPALKRSF

SEQ ID NO: 3067 - protein, 10 aa, Artificial sequence
  Synthetic peptide
SGPALKRSFE

SEQ ID NO: 3068 - protein, 10 aa, Artificial sequence
  Synthetic peptide
GPALKRSFEV

SEQ ID NO: 3069 - protein, 10 aa, Artificial sequence
  Synthetic peptide
PALKRSFEVE

SEQ ID NO: 3070 - protein, 10 aa, Artificial sequence
  Synthetic peptide
ALKRSFEVEE

SEQ ID NO: 3071 - protein, 10 aa, Artificial sequence
  Synthetic peptide
LKRSFEVEEV

SEQ ID NO: 3072 - protein, 10 aa, Artificial sequence
  Synthetic peptide
KRSFEVEEVE

SEQ ID NO: 3073 - protein, 10 aa, Artificial sequence
  Synthetic peptide
RSFEVEEVET

SEQ ID NO: 3074 - protein, 10 aa, Artificial sequence
  Synthetic peptide
SFEVEEVETP

SEQ ID NO: 3075 - protein, 10 aa, Artificial sequence
  Synthetic peptide
FEVEEVETPN

SEQ ID NO: 3076 - protein, 10 aa, Artificial sequence
  Synthetic peptide
EVEEVETPNS

SEQ ID NO: 3077 - protein, 10 aa, Artificial sequence
  Synthetic peptide
VEEVETPNST

SEQ ID NO: 3078 - protein, 10 aa, Artificial sequence
  Synthetic peptide
EEVETPNSTP

SEQ ID NO: 3079 - protein, 10 aa, Artificial sequence
  Synthetic peptide
EVETPNSTPP

SEQ ID NO: 3080 - protein, 10 aa, Artificial sequence
  Synthetic peptide
VETPNSTPPR

SEQ ID NO: 3081 - protein, 10 aa, Artificial sequence
  Synthetic peptide
ETPNSTPPRR

SEQ ID NO: 3082 - protein, 10 aa, Artificial sequence
  Synthetic peptide
TPNSTPPRRV

SEQ ID NO: 3083 - protein, 10 aa, Artificial sequence
  Synthetic peptide
PNSTPPRRVQ

SEQ ID NO: 3084 - protein, 10 aa, Artificial sequence
  Synthetic peptide
NSTPPRRVQT

SEQ ID NO: 3085 - protein, 10 aa, Artificial sequence
  Synthetic peptide
STPPRRVQTP

SEQ ID NO: 3086 - protein, 10 aa, Artificial sequence
  Synthetic peptide
TPPRRVQTPL

SEQ ID NO: 3087 - protein, 10 aa, Artificial sequence
  Synthetic peptide
PPRRVQTPLL

SEQ ID NO: 3088 - protein, 10 aa, Artificial sequence
  Synthetic peptide
PRRVQTPLLR

SEQ ID NO: 3089 - protein, 10 aa, Artificial sequence
  Synthetic peptide
RRVQTPLLRA

SEQ ID NO: 3090 - protein, 10 aa, Artificial sequence
  Synthetic peptide
RVQTPLLRAT

SEQ ID NO: 3091 - protein, 10 aa, Artificial sequence
  Synthetic peptide
VQTPLLRATV

SEQ ID NO: 3092 - protein, 10 aa, Artificial sequence
  Synthetic peptide
QTPLLRATVA

SEQ ID NO: 3093 - protein, 10 aa, Artificial sequence
  Synthetic peptide
TPLLRATVAS

SEQ ID NO: 3094 - protein, 10 aa, Artificial sequence
  Synthetic peptide
PLLRATVASS

SEQ ID NO: 3095 - protein, 10 aa, Artificial sequence
  Synthetic peptide
LLRATVASST

SEQ ID NO: 3096 - protein, 10 aa, Artificial sequence
  Synthetic peptide
LRATVASSTQ

SEQ ID NO: 3097 - protein, 10 aa, Artificial sequence
  Synthetic peptide
RATVASSTQK

SEQ ID NO: 3098 - protein, 10 aa, Artificial sequence
  Synthetic peptide
ATVASSTQKF

SEQ ID NO: 3099 - protein, 10 aa, Artificial sequence
  Synthetic peptide
TVASSTQKFQ

SEQ ID NO: 3100 - protein, 10 aa, Artificial sequence
  Synthetic peptide
VASSTQKFQD

SEQ ID NO: 3101 - protein, 10 aa, Artificial sequence
  Synthetic peptide
ASSTQKFQDL

SEQ ID NO: 3102 - protein, 10 aa, Artificial sequence
  Synthetic peptide
SSTQKFQDLG

SEQ ID NO: 3103 - protein, 10 aa, Artificial sequence
  Synthetic peptide
STQKFQDLGV

SEQ ID NO: 3104 - protein, 10 aa, Artificial sequence
  Synthetic peptide
TQKFQDLGVK

SEQ ID NO: 3105 - protein, 10 aa, Artificial sequence
  Synthetic peptide
QKFQDLGVKN

SEQ ID NO: 3106 - protein, 10 aa, Artificial sequence
  Synthetic peptide
KFQDLGVKNS

SEQ ID NO: 3107 - protein, 10 aa, Artificial sequence
  Synthetic peptide
FQDLGVKNSE

SEQ ID NO: 3108 - protein, 10 aa, Artificial sequence
  Synthetic peptide
QDLGVKNSEP

SEQ ID NO: 3109 - protein, 10 aa, Artificial sequence
  Synthetic peptide
DLGVKNSEPS

SEQ ID NO: 3110 - protein, 10 aa, Artificial sequence
  Synthetic peptide
LGVKNSEPSA

SEQ ID NO: 3111 - protein, 10 aa, Artificial sequence
  Synthetic peptide
GVKNSEPSAR

SEQ ID NO: 3112 - protein, 10 aa, Artificial sequence
  Synthetic peptide
VKNSEPSARH

SEQ ID NO: 3113 - protein, 10 aa, Artificial sequence
  Synthetic peptide
KNSEPSARHV

SEQ ID NO: 3114 - protein, 10 aa, Artificial sequence
  Synthetic peptide
NSEPSARHVD

SEQ ID NO: 3115 - protein, 10 aa, Artificial sequence
  Synthetic peptide
SEPSARHVDS

SEQ ID NO: 3116 - protein, 10 aa, Artificial sequence
  Synthetic peptide
EPSARHVDSL

SEQ ID NO: 3117 - protein, 10 aa, Artificial sequence
  Synthetic peptide
PSARHVDSLS

SEQ ID NO: 3118 - protein, 10 aa, Artificial sequence
  Synthetic peptide
SARHVDSLSQ

SEQ ID NO: 3119 - protein, 10 aa, Artificial sequence
  Synthetic peptide
ARHVDSLSQR

SEQ ID NO: 3120 - protein, 10 aa, Artificial sequence
  Synthetic peptide
RHVDSLSQRS

SEQ ID NO: 3121 - protein, 10 aa, Artificial sequence
  Synthetic peptide
HVDSLSQRSP

SEQ ID NO: 3122 - protein, 10 aa, Artificial sequence
  Synthetic peptide
VDSLSQRSPK

SEQ ID NO: 3123 - protein, 10 aa, Artificial sequence
  Synthetic peptide
DSLSQRSPKA

SEQ ID NO: 3124 - protein, 10 aa, Artificial sequence
  Synthetic peptide
SLSQRSPKAS

SEQ ID NO: 3125 - protein, 10 aa, Artificial sequence
  Synthetic peptide
LSQRSPKASL

SEQ ID NO: 3126 - protein, 10 aa, Artificial sequence
  Synthetic peptide
SQRSPKASLR

SEQ ID NO: 3127 - protein, 10 aa, Artificial sequence
  Synthetic peptide
QRSPKASLRR

SEQ ID NO: 3128 - protein, 10 aa, Artificial sequence
  Synthetic peptide
RSPKASLRRV

SEQ ID NO: 3129 - protein, 10 aa, Artificial sequence
  Synthetic peptide
SPKASLRRVE

SEQ ID NO: 3130 - protein, 10 aa, Artificial sequence
  Synthetic peptide
PKASLRRVEL

SEQ ID NO: 3131 - protein, 10 aa, Artificial sequence
  Synthetic peptide
KASLRRVELS

SEQ ID NO: 3132 - protein, 10 aa, Artificial sequence
  Synthetic peptide
ASLRRVELSG

SEQ ID NO: 3133 - protein, 10 aa, Artificial sequence
  Synthetic peptide
SLRRVELSGP

SEQ ID NO: 3134 - protein, 10 aa, Artificial sequence
  Synthetic peptide
LRRVELSGPK

SEQ ID NO: 3135 - protein, 10 aa, Artificial sequence
  Synthetic peptide
RRVELSGPKA

SEQ ID NO: 3136 - protein, 10 aa, Artificial sequence
  Synthetic peptide
RVELSGPKAA

SEQ ID NO: 3137 - protein, 10 aa, Artificial sequence
  Synthetic peptide
VELSGPKAAE

SEQ ID NO: 3138 - protein, 10 aa, Artificial sequence
  Synthetic peptide
ELSGPKAAEP

SEQ ID NO: 3139 - protein, 10 aa, Artificial sequence
  Synthetic peptide
LSGPKAAEPV

SEQ ID NO: 3140 - protein, 10 aa, Artificial sequence
  Synthetic peptide
SGPKAAEPVS

SEQ ID NO: 3141 - protein, 10 aa, Artificial sequence
  Synthetic peptide
GPKAAEPVSR

SEQ ID NO: 3142 - protein, 10 aa, Artificial sequence
  Synthetic peptide
PKAAEPVSRR

SEQ ID NO: 3143 - protein, 10 aa, Artificial sequence
  Synthetic peptide
KAAEPVSRRT

SEQ ID NO: 3144 - protein, 10 aa, Artificial sequence
  Synthetic peptide
AAEPVSRRTE

SEQ ID NO: 3145 - protein, 10 aa, Artificial sequence
  Synthetic peptide
AEPVSRRTEL

SEQ ID NO: 3146 - protein, 10 aa, Artificial sequence
  Synthetic peptide
EPVSRRTELS

SEQ ID NO: 3147 - protein, 10 aa, Artificial sequence
  Synthetic peptide
PVSRRTELSI

SEQ ID NO: 3148 - protein, 10 aa, Artificial sequence
  Synthetic peptide
VSRRTELSID

SEQ ID NO: 3149 - protein, 10 aa, Artificial sequence
  Synthetic peptide
SRRTELSIDI

SEQ ID NO: 3150 - protein, 10 aa, Artificial sequence
  Synthetic peptide
RRTELSIDIS

SEQ ID NO: 3151 - protein, 10 aa, Artificial sequence
  Synthetic peptide
RTELSIDISS

SEQ ID NO: 3152 - protein, 10 aa, Artificial sequence
  Synthetic peptide
TELSIDISSK

SEQ ID NO: 3153 - protein, 10 aa, Artificial sequence
  Synthetic peptide
ELSIDISSKQ

SEQ ID NO: 3154 - protein, 10 aa, Artificial sequence
  Synthetic peptide
LSIDISSKQV

SEQ ID NO: 3155 - protein, 10 aa, Artificial sequence
  Synthetic peptide
SIDISSKQVE

SEQ ID NO: 3156 - protein, 10 aa, Artificial sequence
  Synthetic peptide
IDISSKQVEN

SEQ ID NO: 3157 - protein, 10 aa, Artificial sequence
  Synthetic peptide
DISSKQVENA

SEQ ID NO: 3158 - protein, 10 aa, Artificial sequence
  Synthetic peptide
ISSKQVENAG

SEQ ID NO: 3159 - protein, 10 aa, Artificial sequence
  Synthetic peptide
SSKQVENAGA

SEQ ID NO: 3160 - protein, 10 aa, Artificial sequence
  Synthetic peptide
SKQVENAGAI

SEQ ID NO: 3161 - protein, 10 aa, Artificial sequence
  Synthetic peptide
KQVENAGAIG

SEQ ID NO: 3162 - protein, 10 aa, Artificial sequence
  Synthetic peptide
QVENAGAIGP

SEQ ID NO: 3163 - protein, 10 aa, Artificial sequence
  Synthetic peptide
VENAGAIGPS

SEQ ID NO: 3164 - protein, 10 aa, Artificial sequence
  Synthetic peptide
ENAGAIGPSR

SEQ ID NO: 3165 - protein, 10 aa, Artificial sequence
  Synthetic peptide
NAGAIGPSRF

SEQ ID NO: 3166 - protein, 10 aa, Artificial sequence
  Synthetic peptide
AGAIGPSRFG

SEQ ID NO: 3167 - protein, 10 aa, Artificial sequence
  Synthetic peptide
GAIGPSRFGL

SEQ ID NO: 3168 - protein, 10 aa, Artificial sequence
  Synthetic peptide
AIGPSRFGLK

SEQ ID NO: 3169 - protein, 10 aa, Artificial sequence
  Synthetic peptide
IGPSRFGLKR

SEQ ID NO: 3170 - protein, 10 aa, Artificial sequence
  Synthetic peptide
GPSRFGLKRA

SEQ ID NO: 3171 - protein, 10 aa, Artificial sequence
  Synthetic peptide
PSRFGLKRAE

SEQ ID NO: 3172 - protein, 10 aa, Artificial sequence
  Synthetic peptide
SRFGLKRAEV

SEQ ID NO: 3173 - protein, 10 aa, Artificial sequence
  Synthetic peptide
RFGLKRAEVL

SEQ ID NO: 3174 - protein, 10 aa, Artificial sequence
  Synthetic peptide
FGLKRAEVLG

SEQ ID NO: 3175 - protein, 10 aa, Artificial sequence
  Synthetic peptide
GLKRAEVLGH

SEQ ID NO: 3176 - protein, 10 aa, Artificial sequence
  Synthetic peptide
LKRAEVLGHK

SEQ ID NO: 3177 - protein, 10 aa, Artificial sequence
  Synthetic peptide
KRAEVLGHKT

SEQ ID NO: 3178 - protein, 10 aa, Artificial sequence
  Synthetic peptide
RAEVLGHKTP

SEQ ID NO: 3179 - protein, 10 aa, Artificial sequence
  Synthetic peptide
AEVLGHKTPE

SEQ ID NO: 3180 - protein, 10 aa, Artificial sequence
  Synthetic peptide
EVLGHKTPEP

SEQ ID NO: 3181 - protein, 10 aa, Artificial sequence
  Synthetic peptide
VLGHKTPEPA

SEQ ID NO: 3182 - protein, 10 aa, Artificial sequence
  Synthetic peptide
LGHKTPEPAP

SEQ ID NO: 3183 - protein, 10 aa, Artificial sequence
  Synthetic peptide
GHKTPEPAPR

SEQ ID NO: 3184 - protein, 10 aa, Artificial sequence
  Synthetic peptide
HKTPEPAPRR

SEQ ID NO: 3185 - protein, 10 aa, Artificial sequence
  Synthetic peptide
KTPEPAPRRT

SEQ ID NO: 3186 - protein, 10 aa, Artificial sequence
  Synthetic peptide
TPEPAPRRTE

SEQ ID NO: 3187 - protein, 10 aa, Artificial sequence
  Synthetic peptide
PEPAPRRTEI

SEQ ID NO: 3188 - protein, 10 aa, Artificial sequence
  Synthetic peptide
EPAPRRTEIT

SEQ ID NO: 3189 - protein, 10 aa, Artificial sequence
  Synthetic peptide
PAPRRTEITI

SEQ ID NO: 3190 - protein, 10 aa, Artificial sequence
  Synthetic peptide
APRRTEITIV

SEQ ID NO: 3191 - protein, 10 aa, Artificial sequence
  Synthetic peptide
PRRTEITIVK

SEQ ID NO: 3192 - protein, 10 aa, Artificial sequence
  Synthetic peptide
RRTEITIVKP

SEQ ID NO: 3193 - protein, 10 aa, Artificial sequence
  Synthetic peptide
RTEITIVKPQ

SEQ ID NO: 3194 - protein, 10 aa, Artificial sequence
  Synthetic peptide
TEITIVKPQE

SEQ ID NO: 3195 - protein, 10 aa, Artificial sequence
  Synthetic peptide
EITIVKPQES

SEQ ID NO: 3196 - protein, 10 aa, Artificial sequence
  Synthetic peptide
ITIVKPQESA

SEQ ID NO: 3197 - protein, 10 aa, Artificial sequence
  Synthetic peptide
TIVKPQESAH

SEQ ID NO: 3198 - protein, 10 aa, Artificial sequence
  Synthetic peptide
IVKPQESAHR

SEQ ID NO: 3199 - protein, 10 aa, Artificial sequence
  Synthetic peptide
VKPQESAHRR

SEQ ID NO: 3200 - protein, 10 aa, Artificial sequence
  Synthetic peptide
KPQESAHRRM

SEQ ID NO: 3201 - protein, 10 aa, Artificial sequence
  Synthetic peptide
PQESAHRRME

SEQ ID NO: 3202 - protein, 10 aa, Artificial sequence
  Synthetic peptide
QESAHRRMEP

SEQ ID NO: 3203 - protein, 10 aa, Artificial sequence
  Synthetic peptide
ESAHRRMEPP

SEQ ID NO: 3204 - protein, 10 aa, Artificial sequence
  Synthetic peptide
SAHRRMEPPA

SEQ ID NO: 3205 - protein, 10 aa, Artificial sequence
  Synthetic peptide
AHRRMEPPAS

SEQ ID NO: 3206 - protein, 10 aa, Artificial sequence
  Synthetic peptide
HRRMEPPASK

SEQ ID NO: 3207 - protein, 10 aa, Artificial sequence
  Synthetic peptide
RRMEPPASKV

SEQ ID NO: 3208 - protein, 10 aa, Artificial sequence
  Synthetic peptide
RMEPPASKVP

SEQ ID NO: 3209 - protein, 10 aa, Artificial sequence
  Synthetic peptide
MEPPASKVPE

SEQ ID NO: 3210 - protein, 10 aa, Artificial sequence
  Synthetic peptide
EPPASKVPEV

SEQ ID NO: 3211 - protein, 10 aa, Artificial sequence
  Synthetic peptide
PPASKVPEVP

SEQ ID NO: 3212 - protein, 10 aa, Artificial sequence
  Synthetic peptide
PASKVPEVPT

SEQ ID NO: 3213 - protein, 10 aa, Artificial sequence
  Synthetic peptide
ASKVPEVPTA

SEQ ID NO: 3214 - protein, 10 aa, Artificial sequence
  Synthetic peptide
SKVPEVPTAP

SEQ ID NO: 3215 - protein, 10 aa, Artificial sequence
  Synthetic peptide
KVPEVPTAPA

SEQ ID NO: 3216 - protein, 10 aa, Artificial sequence
  Synthetic peptide
VPEVPTAPAT

SEQ ID NO: 3217 - protein, 10 aa, Artificial sequence
  Synthetic peptide
PEVPTAPATD

SEQ ID NO: 3218 - protein, 10 aa, Artificial sequence
  Synthetic peptide
EVPTAPATDA

SEQ ID NO: 3219 - protein, 10 aa, Artificial sequence
  Synthetic peptide
VPTAPATDAA

SEQ ID NO: 3220 - protein, 10 aa, Artificial sequence
  Synthetic peptide
PTAPATDAAP

SEQ ID NO: 3221 - protein, 10 aa, Artificial sequence
  Synthetic peptide
TAPATDAAPK

SEQ ID NO: 3222 - protein, 10 aa, Artificial sequence
  Synthetic peptide
APATDAAPKR

SEQ ID NO: 3223 - protein, 10 aa, Artificial sequence
  Synthetic peptide
PATDAAPKRV

SEQ ID NO: 3224 - protein, 10 aa, Artificial sequence
  Synthetic peptide
ATDAAPKRVE

SEQ ID NO: 3225 - protein, 10 aa, Artificial sequence
  Synthetic peptide
TDAAPKRVEI

SEQ ID NO: 3226 - protein, 10 aa, Artificial sequence
  Synthetic peptide
DAAPKRVEIQ

SEQ ID NO: 3227 - protein, 10 aa, Artificial sequence
  Synthetic peptide
AAPKRVEIQM

SEQ ID NO: 3228 - protein, 10 aa, Artificial sequence
  Synthetic peptide
APKRVEIQMP

SEQ ID NO: 3229 - protein, 10 aa, Artificial sequence
  Synthetic peptide
PKRVEIQMPK

SEQ ID NO: 3230 - protein, 10 aa, Artificial sequence
  Synthetic peptide
KRVEIQMPKP

SEQ ID NO: 3231 - protein, 10 aa, Artificial sequence
  Synthetic peptide
RVEIQMPKPA

SEQ ID NO: 3232 - protein, 10 aa, Artificial sequence
  Synthetic peptide
VEIQMPKPAE

SEQ ID NO: 3233 - protein, 10 aa, Artificial sequence
  Synthetic peptide
EIQMPKPAEA

SEQ ID NO: 3234 - protein, 10 aa, Artificial sequence
  Synthetic peptide
IQMPKPAEAP

SEQ ID NO: 3235 - protein, 10 aa, Artificial sequence
  Synthetic peptide
QMPKPAEAPT

SEQ ID NO: 3236 - protein, 10 aa, Artificial sequence
  Synthetic peptide
MPKPAEAPTA

SEQ ID NO: 3237 - protein, 10 aa, Artificial sequence
  Synthetic peptide
PKPAEAPTAP

SEQ ID NO: 3238 - protein, 10 aa, Artificial sequence
  Synthetic peptide
KPAEAPTAPS

SEQ ID NO: 3239 - protein, 10 aa, Artificial sequence
  Synthetic peptide
PAEAPTAPSP

SEQ ID NO: 3240 - protein, 10 aa, Artificial sequence
  Synthetic peptide
AEAPTAPSPA

SEQ ID NO: 3241 - protein, 10 aa, Artificial sequence
  Synthetic peptide
EAPTAPSPAQ

SEQ ID NO: 3242 - protein, 10 aa, Artificial sequence
  Synthetic peptide
APTAPSPAQT

SEQ ID NO: 3243 - protein, 10 aa, Artificial sequence
  Synthetic peptide
PTAPSPAQTL

SEQ ID NO: 3244 - protein, 10 aa, Artificial sequence
  Synthetic peptide
TAPSPAQTLE

SEQ ID NO: 3245 - protein, 10 aa, Artificial sequence
  Synthetic peptide
APSPAQTLEN

SEQ ID NO: 3246 - protein, 10 aa, Artificial sequence
  Synthetic peptide
PSPAQTLENS

SEQ ID NO: 3247 - protein, 10 aa, Artificial sequence
  Synthetic peptide
SPAQTLENSE

SEQ ID NO: 3248 - protein, 10 aa, Artificial sequence
  Synthetic peptide
PAQTLENSEP

SEQ ID NO: 3249 - protein, 10 aa, Artificial sequence
  Synthetic peptide
AQTLENSEPA

SEQ ID NO: 3250 - protein, 10 aa, Artificial sequence
  Synthetic peptide
QTLENSEPAP

SEQ ID NO: 3251 - protein, 10 aa, Artificial sequence
  Synthetic peptide
TLENSEPAPV

SEQ ID NO: 3252 - protein, 10 aa, Artificial sequence
  Synthetic peptide
LENSEPAPVS

SEQ ID NO: 3253 - protein, 10 aa, Artificial sequence
  Synthetic peptide
ENSEPAPVSQ

SEQ ID NO: 3254 - protein, 10 aa, Artificial sequence
  Synthetic peptide
NSEPAPVSQL

SEQ ID NO: 3255 - protein, 10 aa, Artificial sequence
  Synthetic peptide
SEPAPVSQLQ

SEQ ID NO: 3256 - protein, 10 aa, Artificial sequence
  Synthetic peptide
EPAPVSQLQS

SEQ ID NO: 3257 - protein, 10 aa, Artificial sequence
  Synthetic peptide
PAPVSQLQSR

SEQ ID NO: 3258 - protein, 10 aa, Artificial sequence
  Synthetic peptide
APVSQLQSRL

SEQ ID NO: 3259 - protein, 10 aa, Artificial sequence
  Synthetic peptide
PVSQLQSRLE

SEQ ID NO: 3260 - protein, 10 aa, Artificial sequence
  Synthetic peptide
VSQLQSRLEP

SEQ ID NO: 3261 - protein, 10 aa, Artificial sequence
  Synthetic peptide
SQLQSRLEPK

SEQ ID NO: 3262 - protein, 10 aa, Artificial sequence
  Synthetic peptide
QLQSRLEPKP

SEQ ID NO: 3263 - protein, 10 aa, Artificial sequence
  Synthetic peptide
LQSRLEPKPQ

SEQ ID NO: 3264 - protein, 10 aa, Artificial sequence
  Synthetic peptide
QSRLEPKPQP

SEQ ID NO: 3265 - protein, 10 aa, Artificial sequence
  Synthetic peptide
SRLEPKPQPP

SEQ ID NO: 3266 - protein, 10 aa, Artificial sequence
  Synthetic peptide
RLEPKPQPPV

SEQ ID NO: 3267 - protein, 10 aa, Artificial sequence
  Synthetic peptide
LEPKPQPPVA

SEQ ID NO: 3268 - protein, 10 aa, Artificial sequence
  Synthetic peptide
EPKPQPPVAE

SEQ ID NO: 3269 - protein, 10 aa, Artificial sequence
  Synthetic peptide
PKPQPPVAEA

SEQ ID NO: 3270 - protein, 10 aa, Artificial sequence
  Synthetic peptide
KPQPPVAEAT

SEQ ID NO: 3271 - protein, 10 aa, Artificial sequence
  Synthetic peptide
PQPPVAEATP

SEQ ID NO: 3272 - protein, 10 aa, Artificial sequence
  Synthetic peptide
QPPVAEATPR

SEQ ID NO: 3273 - protein, 10 aa, Artificial sequence
  Synthetic peptide
PPVAEATPRS

SEQ ID NO: 3274 - protein, 10 aa, Artificial sequence
  Synthetic peptide
PVAEATPRSQ

SEQ ID NO: 3275 - protein, 10 aa, Artificial sequence
  Synthetic peptide
VAEATPRSQE

SEQ ID NO: 3276 - protein, 10 aa, Artificial sequence
  Synthetic peptide
AEATPRSQEA

SEQ ID NO: 3277 - protein, 10 aa, Artificial sequence
  Synthetic peptide
EATPRSQEAT

SEQ ID NO: 3278 - protein, 10 aa, Artificial sequence
  Synthetic peptide
ATPRSQEATE

SEQ ID NO: 3279 - protein, 10 aa, Artificial sequence
  Synthetic peptide
TPRSQEATEA

SEQ ID NO: 3280 - protein, 10 aa, Artificial sequence
  Synthetic peptide
PRSQEATEAA

SEQ ID NO: 3281 - protein, 10 aa, Artificial sequence
  Synthetic peptide
RSQEATEAAP

SEQ ID NO: 3282 - protein, 10 aa, Artificial sequence
  Synthetic peptide
SQEATEAAPS

SEQ ID NO: 3283 - protein, 10 aa, Artificial sequence
  Synthetic peptide
QEATEAAPSC

SEQ ID NO: 3284 - protein, 10 aa, Artificial sequence
  Synthetic peptide
EATEAAPSCV

SEQ ID NO: 3285 - protein, 10 aa, Artificial sequence
  Synthetic peptide
ATEAAPSCVG

SEQ ID NO: 3286 - protein, 10 aa, Artificial sequence
  Synthetic peptide
TEAAPSCVGD

SEQ ID NO: 3287 - protein, 10 aa, Artificial sequence
  Synthetic peptide
EAAPSCVGDM

SEQ ID NO: 3288 - protein, 10 aa, Artificial sequence
  Synthetic peptide
AAPSCVGDMA

SEQ ID NO: 3289 - protein, 10 aa, Artificial sequence
  Synthetic peptide
APSCVGDMAD

SEQ ID NO: 3290 - protein, 10 aa, Artificial sequence
  Synthetic peptide
PSCVGDMADT

SEQ ID NO: 3291 - protein, 10 aa, Artificial sequence
  Synthetic peptide
SCVGDMADTP

SEQ ID NO: 3292 - protein, 10 aa, Artificial sequence
  Synthetic peptide
CVGDMADTPR

SEQ ID NO: 3293 - protein, 10 aa, Artificial sequence
  Synthetic peptide
VGDMADTPRD

SEQ ID NO: 3294 - protein, 10 aa, Artificial sequence
  Synthetic peptide
GDMADTPRDA

SEQ ID NO: 3295 - protein, 10 aa, Artificial sequence
  Synthetic peptide
DMADTPRDAG

SEQ ID NO: 3296 - protein, 10 aa, Artificial sequence
  Synthetic peptide
MADTPRDAGL

SEQ ID NO: 3297 - protein, 10 aa, Artificial sequence
  Synthetic peptide
ADTPRDAGLK

SEQ ID NO: 3298 - protein, 10 aa, Artificial sequence
  Synthetic peptide
DTPRDAGLKQ

SEQ ID NO: 3299 - protein, 10 aa, Artificial sequence
  Synthetic peptide
TPRDAGLKQA

SEQ ID NO: 3300 - protein, 10 aa, Artificial sequence
  Synthetic peptide
PRDAGLKQAP

SEQ ID NO: 3301 - protein, 10 aa, Artificial sequence
  Synthetic peptide
RDAGLKQAPA

SEQ ID NO: 3302 - protein, 10 aa, Artificial sequence
  Synthetic peptide
DAGLKQAPAS

SEQ ID NO: 3303 - protein, 10 aa, Artificial sequence
  Synthetic peptide
AGLKQAPASR

SEQ ID NO: 3304 - protein, 10 aa, Artificial sequence
  Synthetic peptide
GLKQAPASRN

SEQ ID NO: 3305 - protein, 10 aa, Artificial sequence
  Synthetic peptide
LKQAPASRNE

SEQ ID NO: 3306 - protein, 10 aa, Artificial sequence
  Synthetic peptide
KQAPASRNEK

SEQ ID NO: 3307 - protein, 10 aa, Artificial sequence
  Synthetic peptide
QAPASRNEKA

SEQ ID NO: 3308 - protein, 10 aa, Artificial sequence
  Synthetic peptide
APASRNEKAP

SEQ ID NO: 3309 - protein, 10 aa, Artificial sequence
  Synthetic peptide
PASRNEKAPV

SEQ ID NO: 3310 - protein, 10 aa, Artificial sequence
  Synthetic peptide
ASRNEKAPVD

SEQ ID NO: 3311 - protein, 10 aa, Artificial sequence
  Synthetic peptide
SRNEKAPVDF

SEQ ID NO: 3312 - protein, 10 aa, Artificial sequence
  Synthetic peptide
RNEKAPVDFG

SEQ ID NO: 3313 - protein, 10 aa, Artificial sequence
  Synthetic peptide
NEKAPVDFGY

SEQ ID NO: 3314 - protein, 10 aa, Artificial sequence
  Synthetic peptide
EKAPVDFGYV

SEQ ID NO: 3315 - protein, 10 aa, Artificial sequence
  Synthetic peptide
KAPVDFGYVG

SEQ ID NO: 3316 - protein, 10 aa, Artificial sequence
  Synthetic peptide
APVDFGYVGI

SEQ ID NO: 3317 - protein, 10 aa, Artificial sequence
  Synthetic peptide
PVDFGYVGID

SEQ ID NO: 3318 - protein, 10 aa, Artificial sequence
  Synthetic peptide
VDFGYVGIDS

SEQ ID NO: 3319 - protein, 10 aa, Artificial sequence
  Synthetic peptide
DFGYVGIDSI

SEQ ID NO: 3320 - protein, 10 aa, Artificial sequence
  Synthetic peptide
FGYVGIDSIL

SEQ ID NO: 3321 - protein, 10 aa, Artificial sequence
  Synthetic peptide
GYVGIDSILE

SEQ ID NO: 3322 - protein, 10 aa, Artificial sequence
  Synthetic peptide
YVGIDSILEQ

SEQ ID NO: 3323 - protein, 10 aa, Artificial sequence
  Synthetic peptide
VGIDSILEQM

SEQ ID NO: 3324 - protein, 10 aa, Artificial sequence
  Synthetic peptide
GIDSILEQMR

SEQ ID NO: 3325 - protein, 10 aa, Artificial sequence
  Synthetic peptide
IDSILEQMRR

SEQ ID NO: 3326 - protein, 10 aa, Artificial sequence
  Synthetic peptide
DSILEQMRRK

SEQ ID NO: 3327 - protein, 10 aa, Artificial sequence
  Synthetic peptide
SILEQMRRKA

SEQ ID NO: 3328 - protein, 10 aa, Artificial sequence
  Synthetic peptide
ILEQMRRKAM

SEQ ID NO: 3329 - protein, 10 aa, Artificial sequence
  Synthetic peptide
LEQMRRKAMK

SEQ ID NO: 3330 - protein, 10 aa, Artificial sequence
  Synthetic peptide
EQMRRKAMKQ

SEQ ID NO: 3331 - protein, 10 aa, Artificial sequence
  Synthetic peptide
QMRRKAMKQG

SEQ ID NO: 3332 - protein, 10 aa, Artificial sequence
  Synthetic peptide
MRRKAMKQGF

SEQ ID NO: 3333 - protein, 10 aa, Artificial sequence
  Synthetic peptide
RRKAMKQGFE

SEQ ID NO: 3334 - protein, 10 aa, Artificial sequence
  Synthetic peptide
RKAMKQGFEF

SEQ ID NO: 3335 - protein, 10 aa, Artificial sequence
  Synthetic peptide
KAMKQGFEFN

SEQ ID NO: 3336 - protein, 10 aa, Artificial sequence
  Synthetic peptide
AMKQGFEFNI

SEQ ID NO: 3337 - protein, 10 aa, Artificial sequence
  Synthetic peptide
MKQGFEFNIM

SEQ ID NO: 3338 - protein, 10 aa, Artificial sequence
  Synthetic peptide
KQGFEFNIMV

SEQ ID NO: 3339 - protein, 10 aa, Artificial sequence
  Synthetic peptide
QGFEFNIMVV

SEQ ID NO: 3340 - protein, 10 aa, Artificial sequence
  Synthetic peptide
GFEFNIMVVG

SEQ ID NO: 3341 - protein, 10 aa, Artificial sequence
  Synthetic peptide
FEFNIMVVGQ

SEQ ID NO: 3342 - protein, 10 aa, Artificial sequence
  Synthetic peptide
EFNIMVVGQS

SEQ ID NO: 3343 - protein, 10 aa, Artificial sequence
  Synthetic peptide
FNIMVVGQSG

SEQ ID NO: 3344 - protein, 10 aa, Artificial sequence
  Synthetic peptide
NIMVVGQSGL

SEQ ID NO: 3345 - protein, 10 aa, Artificial sequence
  Synthetic peptide
IMVVGQSGLG

SEQ ID NO: 3346 - protein, 10 aa, Artificial sequence
  Synthetic peptide
MVVGQSGLGK

SEQ ID NO: 3347 - protein, 10 aa, Artificial sequence
  Synthetic peptide
VVGQSGLGKS

SEQ ID NO: 3348 - protein, 10 aa, Artificial sequence
  Synthetic peptide
VGQSGLGKST

SEQ ID NO: 3349 - protein, 10 aa, Artificial sequence
  Synthetic peptide
GQSGLGKSTL

SEQ ID NO: 3350 - protein, 10 aa, Artificial sequence
  Synthetic peptide
QSGLGKSTLI

SEQ ID NO: 3351 - protein, 10 aa, Artificial sequence
  Synthetic peptide
SGLGKSTLIN

SEQ ID NO: 3352 - protein, 10 aa, Artificial sequence
  Synthetic peptide
GLGKSTLINT

SEQ ID NO: 3353 - protein, 10 aa, Artificial sequence
  Synthetic peptide
LGKSTLINTL

SEQ ID NO: 3354 - protein, 10 aa, Artificial sequence
  Synthetic peptide
GKSTLINTLF

SEQ ID NO: 3355 - protein, 10 aa, Artificial sequence
  Synthetic peptide
KSTLINTLFK

SEQ ID NO: 3356 - protein, 10 aa, Artificial sequence
  Synthetic peptide
STLINTLFKS

SEQ ID NO: 3357 - protein, 10 aa, Artificial sequence
  Synthetic peptide
TLINTLFKSK

SEQ ID NO: 3358 - protein, 10 aa, Artificial sequence
  Synthetic peptide
LINTLFKSKI

SEQ ID NO: 3359 - protein, 10 aa, Artificial sequence
  Synthetic peptide
INTLFKSKIS

SEQ ID NO: 3360 - protein, 10 aa, Artificial sequence
  Synthetic peptide
NTLFKSKISR

SEQ ID NO: 3361 - protein, 10 aa, Artificial sequence
  Synthetic peptide
TLFKSKISRK

SEQ ID NO: 3362 - protein, 10 aa, Artificial sequence
  Synthetic peptide
LFKSKISRKS

SEQ ID NO: 3363 - protein, 10 aa, Artificial sequence
  Synthetic peptide
FKSKISRKSV

SEQ ID NO: 3364 - protein, 10 aa, Artificial sequence
  Synthetic peptide
KSKISRKSVQ

SEQ ID NO: 3365 - protein, 10 aa, Artificial sequence
  Synthetic peptide
SKISRKSVQP

SEQ ID NO: 3366 - protein, 10 aa, Artificial sequence
  Synthetic peptide
KISRKSVQPT

SEQ ID NO: 3367 - protein, 10 aa, Artificial sequence
  Synthetic peptide
ISRKSVQPTS

SEQ ID NO: 3368 - protein, 10 aa, Artificial sequence
  Synthetic peptide
SRKSVQPTSE

SEQ ID NO: 3369 - protein, 10 aa, Artificial sequence
  Synthetic peptide
RKSVQPTSEE

SEQ ID NO: 3370 - protein, 10 aa, Artificial sequence
  Synthetic peptide
KSVQPTSEER

SEQ ID NO: 3371 - protein, 10 aa, Artificial sequence
  Synthetic peptide
SVQPTSEERI

SEQ ID NO: 3372 - protein, 10 aa, Artificial sequence
  Synthetic peptide
VQPTSEERIP

SEQ ID NO: 3373 - protein, 10 aa, Artificial sequence
  Synthetic peptide
QPTSEERIPK

SEQ ID NO: 3374 - protein, 10 aa, Artificial sequence
  Synthetic peptide
PTSEERIPKT

SEQ ID NO: 3375 - protein, 10 aa, Artificial sequence
  Synthetic peptide
TSEERIPKTI

SEQ ID NO: 3376 - protein, 10 aa, Artificial sequence
  Synthetic peptide
SEERIPKTIE

SEQ ID NO: 3377 - protein, 10 aa, Artificial sequence
  Synthetic peptide
EERIPKTIEI

SEQ ID NO: 3378 - protein, 10 aa, Artificial sequence
  Synthetic peptide
ERIPKTIEIK

SEQ ID NO: 3379 - protein, 10 aa, Artificial sequence
  Synthetic peptide
RIPKTIEIKS

SEQ ID NO: 3380 - protein, 10 aa, Artificial sequence
  Synthetic peptide
IPKTIEIKSI

SEQ ID NO: 3381 - protein, 10 aa, Artificial sequence
  Synthetic peptide
PKTIEIKSIT

SEQ ID NO: 3382 - protein, 10 aa, Artificial sequence
  Synthetic peptide
KTIEIKSITH

SEQ ID NO: 3383 - protein, 10 aa, Artificial sequence
  Synthetic peptide
TIEIKSITHD

SEQ ID NO: 3384 - protein, 10 aa, Artificial sequence
  Synthetic peptide
IEIKSITHDI

SEQ ID NO: 3385 - protein, 10 aa, Artificial sequence
  Synthetic peptide
EIKSITHDIE

SEQ ID NO: 3386 - protein, 10 aa, Artificial sequence
  Synthetic peptide
IKSITHDIEE

SEQ ID NO: 3387 - protein, 10 aa, Artificial sequence
  Synthetic peptide
KSITHDIEEK

SEQ ID NO: 3388 - protein, 10 aa, Artificial sequence
  Synthetic peptide
SITHDIEEKG

SEQ ID NO: 3389 - protein, 10 aa, Artificial sequence
  Synthetic peptide
ITHDIEEKGV

SEQ ID NO: 3390 - protein, 10 aa, Artificial sequence
  Synthetic peptide
THDIEEKGVR

SEQ ID NO: 3391 - protein, 10 aa, Artificial sequence
  Synthetic peptide
HDIEEKGVRM

SEQ ID NO: 3392 - protein, 10 aa, Artificial sequence
  Synthetic peptide
DIEEKGVRMK

SEQ ID NO: 3393 - protein, 10 aa, Artificial sequence
  Synthetic peptide
IEEKGVRMKL

SEQ ID NO: 3394 - protein, 10 aa, Artificial sequence
  Synthetic peptide
EEKGVRMKLT

SEQ ID NO: 3395 - protein, 10 aa, Artificial sequence
  Synthetic peptide
EKGVRMKLTV

SEQ ID NO: 3396 - protein, 10 aa, Artificial sequence
  Synthetic peptide
KGVRMKLTVI

SEQ ID NO: 3397 - protein, 10 aa, Artificial sequence
  Synthetic peptide
GVRMKLTVID

SEQ ID NO: 3398 - protein, 10 aa, Artificial sequence
  Synthetic peptide
VRMKLTVIDT

SEQ ID NO: 3399 - protein, 10 aa, Artificial sequence
  Synthetic peptide
RMKLTVIDTP

SEQ ID NO: 3400 - protein, 10 aa, Artificial sequence
  Synthetic peptide
MKLTVIDTPG

SEQ ID NO: 3401 - protein, 10 aa, Artificial sequence
  Synthetic peptide
KLTVIDTPGF

SEQ ID NO: 3402 - protein, 10 aa, Artificial sequence
  Synthetic peptide
LTVIDTPGFG

SEQ ID NO: 3403 - protein, 10 aa, Artificial sequence
  Synthetic peptide
TVIDTPGFGD

SEQ ID NO: 3404 - protein, 10 aa, Artificial sequence
  Synthetic peptide
VIDTPGFGDH

SEQ ID NO: 3405 - protein, 10 aa, Artificial sequence
  Synthetic peptide
IDTPGFGDHI

SEQ ID NO: 3406 - protein, 10 aa, Artificial sequence
  Synthetic peptide
DTPGFGDHIN

SEQ ID NO: 3407 - protein, 10 aa, Artificial sequence
  Synthetic peptide
TPGFGDHINN

SEQ ID NO: 3408 - protein, 10 aa, Artificial sequence
  Synthetic peptide
PGFGDHINNE

SEQ ID NO: 3409 - protein, 10 aa, Artificial sequence
  Synthetic peptide
GFGDHINNEN

SEQ ID NO: 3410 - protein, 10 aa, Artificial sequence
  Synthetic peptide
FGDHINNENC

SEQ ID NO: 3411 - protein, 10 aa, Artificial sequence
  Synthetic peptide
GDHINNENCW

SEQ ID NO: 3412 - protein, 10 aa, Artificial sequence
  Synthetic peptide
DHINNENCWQ

SEQ ID NO: 3413 - protein, 10 aa, Artificial sequence
  Synthetic peptide
HINNENCWQP

SEQ ID NO: 3414 - protein, 10 aa, Artificial sequence
  Synthetic peptide
INNENCWQPI

SEQ ID NO: 3415 - protein, 10 aa, Artificial sequence
  Synthetic peptide
NNENCWQPIM

SEQ ID NO: 3416 - protein, 10 aa, Artificial sequence
  Synthetic peptide
NENCWQPIMK

SEQ ID NO: 3417 - protein, 10 aa, Artificial sequence
  Synthetic peptide
ENCWQPIMKF

SEQ ID NO: 3418 - protein, 10 aa, Artificial sequence
  Synthetic peptide
NCWQPIMKFI

SEQ ID NO: 3419 - protein, 10 aa, Artificial sequence
  Synthetic peptide
CWQPIMKFIN

SEQ ID NO: 3420 - protein, 10 aa, Artificial sequence
  Synthetic peptide
WQPIMKFIND

SEQ ID NO: 3421 - protein, 10 aa, Artificial sequence
  Synthetic peptide
QPIMKFINDQ

SEQ ID NO: 3422 - protein, 10 aa, Artificial sequence
  Synthetic peptide
PIMKFINDQY

SEQ ID NO: 3423 - protein, 10 aa, Artificial sequence
  Synthetic peptide
IMKFINDQYE

SEQ ID NO: 3424 - protein, 10 aa, Artificial sequence
  Synthetic peptide
MKFINDQYEK

SEQ ID NO: 3425 - protein, 10 aa, Artificial sequence
  Synthetic peptide
KFINDQYEKY

SEQ ID NO: 3426 - protein, 10 aa, Artificial sequence
  Synthetic peptide
FINDQYEKYL

SEQ ID NO: 3427 - protein, 10 aa, Artificial sequence
  Synthetic peptide
INDQYEKYLQ

SEQ ID NO: 3428 - protein, 10 aa, Artificial sequence
  Synthetic peptide
NDQYEKYLQE

SEQ ID NO: 3429 - protein, 10 aa, Artificial sequence
  Synthetic peptide
DQYEKYLQEE

SEQ ID NO: 3430 - protein, 10 aa, Artificial sequence
  Synthetic peptide
QYEKYLQEEV

SEQ ID NO: 3431 - protein, 10 aa, Artificial sequence
  Synthetic peptide
YEKYLQEEVN

SEQ ID NO: 3432 - protein, 10 aa, Artificial sequence
  Synthetic peptide
EKYLQEEVNI

SEQ ID NO: 3433 - protein, 10 aa, Artificial sequence
  Synthetic peptide
KYLQEEVNIN

SEQ ID NO: 3434 - protein, 10 aa, Artificial sequence
  Synthetic peptide
YLQEEVNINR

SEQ ID NO: 3435 - protein, 10 aa, Artificial sequence
  Synthetic peptide
LQEEVNINRK

SEQ ID NO: 3436 - protein, 10 aa, Artificial sequence
  Synthetic peptide
QEEVNINRKK

SEQ ID NO: 3437 - protein, 10 aa, Artificial sequence
  Synthetic peptide
EEVNINRKKR

SEQ ID NO: 3438 - protein, 10 aa, Artificial sequence
  Synthetic peptide
EVNINRKKRI

SEQ ID NO: 3439 - protein, 10 aa, Artificial sequence
  Synthetic peptide
VNINRKKRIP

SEQ ID NO: 3440 - protein, 10 aa, Artificial sequence
  Synthetic peptide
NINRKKRIPD

SEQ ID NO: 3441 - protein, 10 aa, Artificial sequence
  Synthetic peptide
INRKKRIPDT

SEQ ID NO: 3442 - protein, 10 aa, Artificial sequence
  Synthetic peptide
NRKKRIPDTR

SEQ ID NO: 3443 - protein, 10 aa, Artificial sequence
  Synthetic peptide
RKKRIPDTRV

SEQ ID NO: 3444 - protein, 10 aa, Artificial sequence
  Synthetic peptide
KKRIPDTRVH

SEQ ID NO: 3445 - protein, 10 aa, Artificial sequence
  Synthetic peptide
KRIPDTRVHC

SEQ ID NO: 3446 - protein, 10 aa, Artificial sequence
  Synthetic peptide
RIPDTRVHCC

SEQ ID NO: 3447 - protein, 10 aa, Artificial sequence
  Synthetic peptide
IPDTRVHCCL

SEQ ID NO: 3448 - protein, 10 aa, Artificial sequence
  Synthetic peptide
PDTRVHCCLY

SEQ ID NO: 3449 - protein, 10 aa, Artificial sequence
  Synthetic peptide
DTRVHCCLYF

SEQ ID NO: 3450 - protein, 10 aa, Artificial sequence
  Synthetic peptide
TRVHCCLYFI

SEQ ID NO: 3451 - protein, 10 aa, Artificial sequence
  Synthetic peptide
RVHCCLYFIP

SEQ ID NO: 3452 - protein, 10 aa, Artificial sequence
  Synthetic peptide
VHCCLYFIPA

SEQ ID NO: 3453 - protein, 10 aa, Artificial sequence
  Synthetic peptide
HCCLYFIPAT

SEQ ID NO: 3454 - protein, 10 aa, Artificial sequence
  Synthetic peptide
CCLYFIPATG

SEQ ID NO: 3455 - protein, 10 aa, Artificial sequence
  Synthetic peptide
CLYFIPATGH

SEQ ID NO: 3456 - protein, 10 aa, Artificial sequence
  Synthetic peptide
LYFIPATGHS

SEQ ID NO: 3457 - protein, 10 aa, Artificial sequence
  Synthetic peptide
YFIPATGHSL

SEQ ID NO: 3458 - protein, 10 aa, Artificial sequence
  Synthetic peptide
FIPATGHSLR

SEQ ID NO: 3459 - protein, 10 aa, Artificial sequence
  Synthetic peptide
IPATGHSLRP

SEQ ID NO: 3460 - protein, 10 aa, Artificial sequence
  Synthetic peptide
PATGHSLRPL

SEQ ID NO: 3461 - protein, 10 aa, Artificial sequence
  Synthetic peptide
ATGHSLRPLD

SEQ ID NO: 3462 - protein, 10 aa, Artificial sequence
  Synthetic peptide
TGHSLRPLDI

SEQ ID NO: 3463 - protein, 10 aa, Artificial sequence
  Synthetic peptide
GHSLRPLDIE

SEQ ID NO: 3464 - protein, 10 aa, Artificial sequence
  Synthetic peptide
HSLRPLDIEF

SEQ ID NO: 3465 - protein, 10 aa, Artificial sequence
  Synthetic peptide
SLRPLDIEFM

SEQ ID NO: 3466 - protein, 10 aa, Artificial sequence
  Synthetic peptide
LRPLDIEFMK

SEQ ID NO: 3467 - protein, 10 aa, Artificial sequence
  Synthetic peptide
RPLDIEFMKR

SEQ ID NO: 3468 - protein, 10 aa, Artificial sequence
  Synthetic peptide
PLDIEFMKRL

SEQ ID NO: 3469 - protein, 10 aa, Artificial sequence
  Synthetic peptide
LDIEFMKRLS

SEQ ID NO: 3470 - protein, 10 aa, Artificial sequence
  Synthetic peptide
DIEFMKRLSK

SEQ ID NO: 3471 - protein, 10 aa, Artificial sequence
  Synthetic peptide
IEFMKRLSKV

SEQ ID NO: 3472 - protein, 10 aa, Artificial sequence
  Synthetic peptide
EFMKRLSKVV

SEQ ID NO: 3473 - protein, 10 aa, Artificial sequence
  Synthetic peptide
FMKRLSKVVN

SEQ ID NO: 3474 - protein, 10 aa, Artificial sequence
  Synthetic peptide
MKRLSKVVNI

SEQ ID NO: 3475 - protein, 10 aa, Artificial sequence
  Synthetic peptide
KRLSKVVNIV

SEQ ID NO: 3476 - protein, 10 aa, Artificial sequence
  Synthetic peptide
RLSKVVNIVP

SEQ ID NO: 3477 - protein, 10 aa, Artificial sequence
  Synthetic peptide
LSKVVNIVPV

SEQ ID NO: 3478 - protein, 10 aa, Artificial sequence
  Synthetic peptide
SKVVNIVPVI

SEQ ID NO: 3479 - protein, 10 aa, Artificial sequence
  Synthetic peptide
KVVNIVPVIA

SEQ ID NO: 3480 - protein, 10 aa, Artificial sequence
  Synthetic peptide
VVNIVPVIAK

SEQ ID NO: 3481 - protein, 10 aa, Artificial sequence
  Synthetic peptide
VNIVPVIAKA

SEQ ID NO: 3482 - protein, 10 aa, Artificial sequence
  Synthetic peptide
NIVPVIAKAD

SEQ ID NO: 3483 - protein, 10 aa, Artificial sequence
  Synthetic peptide
IVPVIAKADT

SEQ ID NO: 3484 - protein, 10 aa, Artificial sequence
  Synthetic peptide
VPVIAKADTL

SEQ ID NO: 3485 - protein, 10 aa, Artificial sequence
  Synthetic peptide
PVIAKADTLT

SEQ ID NO: 3486 - protein, 10 aa, Artificial sequence
  Synthetic peptide
VIAKADTLTL

SEQ ID NO: 3487 - protein, 10 aa, Artificial sequence
  Synthetic peptide
IAKADTLTLE

SEQ ID NO: 3488 - protein, 10 aa, Artificial sequence
  Synthetic peptide
AKADTLTLEE

SEQ ID NO: 3489 - protein, 10 aa, Artificial sequence
  Synthetic peptide
KADTLTLEER

SEQ ID NO: 3490 - protein, 10 aa, Artificial sequence
  Synthetic peptide
ADTLTLEERV

SEQ ID NO: 3491 - protein, 10 aa, Artificial sequence
  Synthetic peptide
DTLTLEERVH

SEQ ID NO: 3492 - protein, 10 aa, Artificial sequence
  Synthetic peptide
TLTLEERVHF

SEQ ID NO: 3493 - protein, 10 aa, Artificial sequence
  Synthetic peptide
LTLEERVHFK

SEQ ID NO: 3494 - protein, 10 aa, Artificial sequence
  Synthetic peptide
TLEERVHFKQ

SEQ ID NO: 3495 - protein, 10 aa, Artificial sequence
  Synthetic peptide
LEERVHFKQR

SEQ ID NO: 3496 - protein, 10 aa, Artificial sequence
  Synthetic peptide
EERVHFKQRI

SEQ ID NO: 3497 - protein, 10 aa, Artificial sequence
  Synthetic peptide
ERVHFKQRIT

SEQ ID NO: 3498 - protein, 10 aa, Artificial sequence
  Synthetic peptide
RVHFKQRITA

SEQ ID NO: 3499 - protein, 10 aa, Artificial sequence
  Synthetic peptide
VHFKQRITAD

SEQ ID NO: 3500 - protein, 10 aa, Artificial sequence
  Synthetic peptide
HFKQRITADL

SEQ ID NO: 3501 - protein, 10 aa, Artificial sequence
  Synthetic peptide
FKQRITADLL

SEQ ID NO: 3502 - protein, 10 aa, Artificial sequence
  Synthetic peptide
KQRITADLLS

SEQ ID NO: 3503 - protein, 10 aa, Artificial sequence
  Synthetic peptide
QRITADLLSN

SEQ ID NO: 3504 - protein, 10 aa, Artificial sequence
  Synthetic peptide
RITADLLSNG

SEQ ID NO: 3505 - protein, 10 aa, Artificial sequence
  Synthetic peptide
ITADLLSNGI

SEQ ID NO: 3506 - protein, 10 aa, Artificial sequence
  Synthetic peptide
TADLLSNGID

SEQ ID NO: 3507 - protein, 10 aa, Artificial sequence
  Synthetic peptide
ADLLSNGIDV

SEQ ID NO: 3508 - protein, 10 aa, Artificial sequence
  Synthetic peptide
DLLSNGIDVY

SEQ ID NO: 3509 - protein, 10 aa, Artificial sequence
  Synthetic peptide
LLSNGIDVYP

SEQ ID NO: 3510 - protein, 10 aa, Artificial sequence
  Synthetic peptide
LSNGIDVYPQ

SEQ ID NO: 3511 - protein, 10 aa, Artificial sequence
  Synthetic peptide
SNGIDVYPQK

SEQ ID NO: 3512 - protein, 10 aa, Artificial sequence
  Synthetic peptide
NGIDVYPQKE

SEQ ID NO: 3513 - protein, 10 aa, Artificial sequence
  Synthetic peptide
GIDVYPQKEF

SEQ ID NO: 3514 - protein, 10 aa, Artificial sequence
  Synthetic peptide
IDVYPQKEFD

SEQ ID NO: 3515 - protein, 10 aa, Artificial sequence
  Synthetic peptide
DVYPQKEFDE

SEQ ID NO: 3516 - protein, 10 aa, Artificial sequence
  Synthetic peptide
VYPQKEFDED

SEQ ID NO: 3517 - protein, 10 aa, Artificial sequence
  Synthetic peptide
YPQKEFDEDS

SEQ ID NO: 3518 - protein, 10 aa, Artificial sequence
  Synthetic peptide
PQKEFDEDSE

SEQ ID NO: 3519 - protein, 10 aa, Artificial sequence
  Synthetic peptide
QKEFDEDSED

SEQ ID NO: 3520 - protein, 10 aa, Artificial sequence
  Synthetic peptide
KEFDEDSEDR

SEQ ID NO: 3521 - protein, 10 aa, Artificial sequence
  Synthetic peptide
EFDEDSEDRL

SEQ ID NO: 3522 - protein, 10 aa, Artificial sequence
  Synthetic peptide
FDEDSEDRLV

SEQ ID NO: 3523 - protein, 10 aa, Artificial sequence
  Synthetic peptide
DEDSEDRLVN

SEQ ID NO: 3524 - protein, 10 aa, Artificial sequence
  Synthetic peptide
EDSEDRLVNE

SEQ ID NO: 3525 - protein, 10 aa, Artificial sequence
  Synthetic peptide
DSEDRLVNEK

SEQ ID NO: 3526 - protein, 10 aa, Artificial sequence
  Synthetic peptide
SEDRLVNEKF

SEQ ID NO: 3527 - protein, 10 aa, Artificial sequence
  Synthetic peptide
EDRLVNEKFR

SEQ ID NO: 3528 - protein, 10 aa, Artificial sequence
  Synthetic peptide
DRLVNEKFRE

SEQ ID NO: 3529 - protein, 10 aa, Artificial sequence
  Synthetic peptide
RLVNEKFREM

SEQ ID NO: 3530 - protein, 10 aa, Artificial sequence
  Synthetic peptide
LVNEKFREMI

SEQ ID NO: 3531 - protein, 10 aa, Artificial sequence
  Synthetic peptide
VNEKFREMIP

SEQ ID NO: 3532 - protein, 10 aa, Artificial sequence
  Synthetic peptide
NEKFREMIPF

SEQ ID NO: 3533 - protein, 10 aa, Artificial sequence
  Synthetic peptide
EKFREMIPFA

SEQ ID NO: 3534 - protein, 10 aa, Artificial sequence
  Synthetic peptide
KFREMIPFAV

SEQ ID NO: 3535 - protein, 10 aa, Artificial sequence
  Synthetic peptide
FREMIPFAVV

SEQ ID NO: 3536 - protein, 10 aa, Artificial sequence
  Synthetic peptide
REMIPFAVVG

SEQ ID NO: 3537 - protein, 10 aa, Artificial sequence
  Synthetic peptide
EMIPFAVVGS

SEQ ID NO: 3538 - protein, 10 aa, Artificial sequence
  Synthetic peptide
MIPFAVVGSD

SEQ ID NO: 3539 - protein, 10 aa, Artificial sequence
  Synthetic peptide
IPFAVVGSDH

SEQ ID NO: 3540 - protein, 10 aa, Artificial sequence
  Synthetic peptide
PFAVVGSDHE

SEQ ID NO: 3541 - protein, 10 aa, Artificial sequence
  Synthetic peptide
FAVVGSDHEY

SEQ ID NO: 3542 - protein, 10 aa, Artificial sequence
  Synthetic peptide
AVVGSDHEYQ

SEQ ID NO: 3543 - protein, 10 aa, Artificial sequence
  Synthetic peptide
VVGSDHEYQV

SEQ ID NO: 3544 - protein, 10 aa, Artificial sequence
  Synthetic peptide
VGSDHEYQVN

SEQ ID NO: 3545 - protein, 10 aa, Artificial sequence
  Synthetic peptide
GSDHEYQVNG

SEQ ID NO: 3546 - protein, 10 aa, Artificial sequence
  Synthetic peptide
SDHEYQVNGK

SEQ ID NO: 3547 - protein, 10 aa, Artificial sequence
  Synthetic peptide
DHEYQVNGKR

SEQ ID NO: 3548 - protein, 10 aa, Artificial sequence
  Synthetic peptide
HEYQVNGKRI

SEQ ID NO: 3549 - protein, 10 aa, Artificial sequence
  Synthetic peptide
EYQVNGKRIL

SEQ ID NO: 3550 - protein, 10 aa, Artificial sequence
  Synthetic peptide
YQVNGKRILG

SEQ ID NO: 3551 - protein, 10 aa, Artificial sequence
  Synthetic peptide
QVNGKRILGR

SEQ ID NO: 3552 - protein, 10 aa, Artificial sequence
  Synthetic peptide
VNGKRILGRK

SEQ ID NO: 3553 - protein, 10 aa, Artificial sequence
  Synthetic peptide
NGKRILGRKT

SEQ ID NO: 3554 - protein, 10 aa, Artificial sequence
  Synthetic peptide
GKRILGRKTK

SEQ ID NO: 3555 - protein, 10 aa, Artificial sequence
  Synthetic peptide
KRILGRKTKW

SEQ ID NO: 3556 - protein, 10 aa, Artificial sequence
  Synthetic peptide
RILGRKTKWG

SEQ ID NO: 3557 - protein, 10 aa, Artificial sequence
  Synthetic peptide
ILGRKTKWGT

SEQ ID NO: 3558 - protein, 10 aa, Artificial sequence
  Synthetic peptide
LGRKTKWGTI

SEQ ID NO: 3559 - protein, 10 aa, Artificial sequence
  Synthetic peptide
GRKTKWGTIE

SEQ ID NO: 3560 - protein, 10 aa, Artificial sequence
  Synthetic peptide
RKTKWGTIEV

SEQ ID NO: 3561 - protein, 10 aa, Artificial sequence
  Synthetic peptide
KTKWGTIEVE

SEQ ID NO: 3562 - protein, 10 aa, Artificial sequence
  Synthetic peptide
TKWGTIEVEN

SEQ ID NO: 3563 - protein, 10 aa, Artificial sequence
  Synthetic peptide
KWGTIEVENT

SEQ ID NO: 3564 - protein, 10 aa, Artificial sequence
  Synthetic peptide
WGTIEVENTT

SEQ ID NO: 3565 - protein, 10 aa, Artificial sequence
  Synthetic peptide
GTIEVENTTH

SEQ ID NO: 3566 - protein, 10 aa, Artificial sequence
  Synthetic peptide
TIEVENTTHC

SEQ ID NO: 3567 - protein, 10 aa, Artificial sequence
  Synthetic peptide
IEVENTTHCE

SEQ ID NO: 3568 - protein, 10 aa, Artificial sequence
  Synthetic peptide
EVENTTHCEF

SEQ ID NO: 3569 - protein, 10 aa, Artificial sequence
  Synthetic peptide
VENTTHCEFA

SEQ ID NO: 3570 - protein, 10 aa, Artificial sequence
  Synthetic peptide
ENTTHCEFAY

SEQ ID NO: 3571 - protein, 10 aa, Artificial sequence
  Synthetic peptide
NTTHCEFAYL

SEQ ID NO: 3572 - protein, 10 aa, Artificial sequence
  Synthetic peptide
TTHCEFAYLR

SEQ ID NO: 3573 - protein, 10 aa, Artificial sequence
  Synthetic peptide
THCEFAYLRD

SEQ ID NO: 3574 - protein, 10 aa, Artificial sequence
  Synthetic peptide
HCEFAYLRDL

SEQ ID NO: 3575 - protein, 10 aa, Artificial sequence
  Synthetic peptide
CEFAYLRDLL

SEQ ID NO: 3576 - protein, 10 aa, Artificial sequence
  Synthetic peptide
EFAYLRDLLI

SEQ ID NO: 3577 - protein, 10 aa, Artificial sequence
  Synthetic peptide
FAYLRDLLIR

SEQ ID NO: 3578 - protein, 10 aa, Artificial sequence
  Synthetic peptide
AYLRDLLIRT

SEQ ID NO: 3579 - protein, 10 aa, Artificial sequence
  Synthetic peptide
YLRDLLIRTH

SEQ ID NO: 3580 - protein, 10 aa, Artificial sequence
  Synthetic peptide
LRDLLIRTHM

SEQ ID NO: 3581 - protein, 10 aa, Artificial sequence
  Synthetic peptide
RDLLIRTHMQ

SEQ ID NO: 3582 - protein, 10 aa, Artificial sequence
  Synthetic peptide
DLLIRTHMQN

SEQ ID NO: 3583 - protein, 10 aa, Artificial sequence
  Synthetic peptide
LLIRTHMQNI

SEQ ID NO: 3584 - protein, 10 aa, Artificial sequence
  Synthetic peptide
LIRTHMQNIK

SEQ ID NO: 3585 - protein, 10 aa, Artificial sequence
  Synthetic peptide
IRTHMQNIKD

SEQ ID NO: 3586 - protein, 10 aa, Artificial sequence
  Synthetic peptide
RTHMQNIKDI

SEQ ID NO: 3587 - protein, 10 aa, Artificial sequence
  Synthetic peptide
THMQNIKDIT

SEQ ID NO: 3588 - protein, 10 aa, Artificial sequence
  Synthetic peptide
HMQNIKDITS

SEQ ID NO: 3589 - protein, 10 aa, Artificial sequence
  Synthetic peptide
MQNIKDITSS

SEQ ID NO: 3590 - protein, 10 aa, Artificial sequence
  Synthetic peptide
QNIKDITSSI

SEQ ID NO: 3591 - protein, 10 aa, Artificial sequence
  Synthetic peptide
NIKDITSSIH

SEQ ID NO: 3592 - protein, 10 aa, Artificial sequence
  Synthetic peptide
IKDITSSIHF

SEQ ID NO: 3593 - protein, 10 aa, Artificial sequence
  Synthetic peptide
KDITSSIHFE

SEQ ID NO: 3594 - protein, 10 aa, Artificial sequence
  Synthetic peptide
DITSSIHFEA

SEQ ID NO: 3595 - protein, 10 aa, Artificial sequence
  Synthetic peptide
ITSSIHFEAY

SEQ ID NO: 3596 - protein, 10 aa, Artificial sequence
  Synthetic peptide
TSSIHFEAYR

SEQ ID NO: 3597 - protein, 10 aa, Artificial sequence
  Synthetic peptide
SSIHFEAYRV

SEQ ID NO: 3598 - protein, 10 aa, Artificial sequence
  Synthetic peptide
SIHFEAYRVK

SEQ ID NO: 3599 - protein, 10 aa, Artificial sequence
  Synthetic peptide
IHFEAYRVKR

SEQ ID NO: 3600 - protein, 10 aa, Artificial sequence
  Synthetic peptide
HFEAYRVKRL

SEQ ID NO: 3601 - protein, 10 aa, Artificial sequence
  Synthetic peptide
FEAYRVKRLN

SEQ ID NO: 3602 - protein, 10 aa, Artificial sequence
  Synthetic peptide
EAYRVKRLNE

SEQ ID NO: 3603 - protein, 10 aa, Artificial sequence
  Synthetic peptide
AYRVKRLNEG

SEQ ID NO: 3604 - protein, 10 aa, Artificial sequence
  Synthetic peptide
YRVKRLNEGS

SEQ ID NO: 3605 - protein, 10 aa, Artificial sequence
  Synthetic peptide
RVKRLNEGSS

SEQ ID NO: 3606 - protein, 10 aa, Artificial sequence
  Synthetic peptide
VKRLNEGSSA

SEQ ID NO: 3607 - protein, 10 aa, Artificial sequence
  Synthetic peptide
KRLNEGSSAM

SEQ ID NO: 3608 - protein, 10 aa, Artificial sequence
  Synthetic peptide
RLNEGSSAMA

SEQ ID NO: 3609 - protein, 10 aa, Artificial sequence
  Synthetic peptide
LNEGSSAMAN

SEQ ID NO: 3610 - protein, 10 aa, Artificial sequence
  Synthetic peptide
NEGSSAMANG

SEQ ID NO: 3611 - protein, 10 aa, Artificial sequence
  Synthetic peptide
EGSSAMANGV

SEQ ID NO: 3612 - protein, 10 aa, Artificial sequence
  Synthetic peptide
GSSAMANGVE

SEQ ID NO: 3613 - protein, 10 aa, Artificial sequence
  Synthetic peptide
SSAMANGVEE

SEQ ID NO: 3614 - protein, 10 aa, Artificial sequence
  Synthetic peptide
SAMANGVEEK

SEQ ID NO: 3615 - protein, 10 aa, Artificial sequence
  Synthetic peptide
AMANGVEEKE

SEQ ID NO: 3616 - protein, 10 aa, Artificial sequence
  Synthetic peptide
MANGVEEKEP

SEQ ID NO: 3617 - protein, 10 aa, Artificial sequence
  Synthetic peptide
ANGVEEKEPE

SEQ ID NO: 3618 - protein, 10 aa, Artificial sequence
  Synthetic peptide
NGVEEKEPEA

SEQ ID NO: 3619 - protein, 10 aa, Artificial sequence
  Synthetic peptide
GVEEKEPEAP

SEQ ID NO: 3620 - protein, 10 aa, Artificial sequence
  Synthetic peptide
VEEKEPEAPE

SEQ ID NO: 3621 - protein, 10 aa, Artificial sequence
  Synthetic peptide
EEKEPEAPEM

SEQ ID NO: 3622 - protein, 15 aa, Artificial sequence
  Synthetic peptide
MKKSYSGGTRTSSGR

SEQ ID NO: 3623 - protein, 15 aa, Artificial sequence
  Synthetic peptide
KKSYSGGTRTSSGRL

SEQ ID NO: 3624 - protein, 15 aa, Artificial sequence
  Synthetic peptide
KSYSGGTRTSSGRLR

SEQ ID NO: 3625 - protein, 15 aa, Artificial sequence
  Synthetic peptide
SYSGGTRTSSGRLRR

SEQ ID NO: 3626 - protein, 15 aa, Artificial sequence
  Synthetic peptide
YSGGTRTSSGRLRRL

SEQ ID NO: 3627 - protein, 15 aa, Artificial sequence
  Synthetic peptide
SGGTRTSSGRLRRLG

SEQ ID NO: 3628 - protein, 15 aa, Artificial sequence
  Synthetic peptide
GGTRTSSGRLRRLGD

SEQ ID NO: 3629 - protein, 15 aa, Artificial sequence
  Synthetic peptide
GTRTSSGRLRRLGDS

SEQ ID NO: 3630 - protein, 15 aa, Artificial sequence
  Synthetic peptide
TRTSSGRLRRLGDSS

SEQ ID NO: 3631 - protein, 15 aa, Artificial sequence
  Synthetic peptide
RTSSGRLRRLGDSSG

SEQ ID NO: 3632 - protein, 15 aa, Artificial sequence
  Synthetic peptide
TSSGRLRRLGDSSGP

SEQ ID NO: 3633 - protein, 15 aa, Artificial sequence
  Synthetic peptide
SSGRLRRLGDSSGPA

SEQ ID NO: 3634 - protein, 15 aa, Artificial sequence
  Synthetic peptide
SGRLRRLGDSSGPAL

SEQ ID NO: 3635 - protein, 15 aa, Artificial sequence
  Synthetic peptide
GRLRRLGDSSGPALK

SEQ ID NO: 3636 - protein, 15 aa, Artificial sequence
  Synthetic peptide
RLRRLGDSSGPALKR

SEQ ID NO: 3637 - protein, 15 aa, Artificial sequence
  Synthetic peptide
LRRLGDSSGPALKRS

SEQ ID NO: 3638 - protein, 15 aa, Artificial sequence
  Synthetic peptide
RRLGDSSGPALKRSF

SEQ ID NO: 3639 - protein, 15 aa, Artificial sequence
  Synthetic peptide
RLGDSSGPALKRSFE

SEQ ID NO: 3640 - protein, 15 aa, Artificial sequence
  Synthetic peptide
LGDSSGPALKRSFEV

SEQ ID NO: 3641 - protein, 15 aa, Artificial sequence
  Synthetic peptide
GDSSGPALKRSFEVE

SEQ ID NO: 3642 - protein, 15 aa, Artificial sequence
  Synthetic peptide
DSSGPALKRSFEVEE

SEQ ID NO: 3643 - protein, 15 aa, Artificial sequence
  Synthetic peptide
SSGPALKRSFEVEEV

SEQ ID NO: 3644 - protein, 15 aa, Artificial sequence
  Synthetic peptide
SGPALKRSFEVEEVE

SEQ ID NO: 3645 - protein, 15 aa, Artificial sequence
  Synthetic peptide
GPALKRSFEVEEVET

SEQ ID NO: 3646 - protein, 15 aa, Artificial sequence
  Synthetic peptide
PALKRSFEVEEVETP

SEQ ID NO: 3647 - protein, 15 aa, Artificial sequence
  Synthetic peptide
ALKRSFEVEEVETPN

SEQ ID NO: 3648 - protein, 15 aa, Artificial sequence
  Synthetic peptide
LKRSFEVEEVETPNS

SEQ ID NO: 3649 - protein, 15 aa, Artificial sequence
  Synthetic peptide
KRSFEVEEVETPNST

SEQ ID NO: 3650 - protein, 15 aa, Artificial sequence
  Synthetic peptide
RSFEVEEVETPNSTP

SEQ ID NO: 3651 - protein, 15 aa, Artificial sequence
  Synthetic peptide
SFEVEEVETPNSTPP

SEQ ID NO: 3652 - protein, 15 aa, Artificial sequence
  Synthetic peptide
FEVEEVETPNSTPPR

SEQ ID NO: 3653 - protein, 15 aa, Artificial sequence
  Synthetic peptide
EVEEVETPNSTPPRR

SEQ ID NO: 3654 - protein, 15 aa, Artificial sequence
  Synthetic peptide
VEEVETPNSTPPRRV

SEQ ID NO: 3655 - protein, 15 aa, Artificial sequence
  Synthetic peptide
EEVETPNSTPPRRVQ

SEQ ID NO: 3656 - protein, 15 aa, Artificial sequence
  Synthetic peptide
EVETPNSTPPRRVQT

SEQ ID NO: 3657 - protein, 15 aa, Artificial sequence
  Synthetic peptide
VETPNSTPPRRVQTP

SEQ ID NO: 3658 - protein, 15 aa, Artificial sequence
  Synthetic peptide
ETPNSTPPRRVQTPL

SEQ ID NO: 3659 - protein, 15 aa, Artificial sequence
  Synthetic peptide
TPNSTPPRRVQTPLL

SEQ ID NO: 3660 - protein, 15 aa, Artificial sequence
  Synthetic peptide
PNSTPPRRVQTPLLR

SEQ ID NO: 3661 - protein, 15 aa, Artificial sequence
  Synthetic peptide
NSTPPRRVQTPLLRA

SEQ ID NO: 3662 - protein, 15 aa, Artificial sequence
  Synthetic peptide
STPPRRVQTPLLRAT

SEQ ID NO: 3663 - protein, 15 aa, Artificial sequence
  Synthetic peptide
TPPRRVQTPLLRATV

SEQ ID NO: 3664 - protein, 15 aa, Artificial sequence
  Synthetic peptide
PPRRVQTPLLRATVA

SEQ ID NO: 3665 - protein, 15 aa, Artificial sequence
  Synthetic peptide
PRRVQTPLLRATVAS

SEQ ID NO: 3666 - protein, 15 aa, Artificial sequence
  Synthetic peptide
RRVQTPLLRATVASS

SEQ ID NO: 3667 - protein, 15 aa, Artificial sequence
  Synthetic peptide
RVQTPLLRATVASST

SEQ ID NO: 3668 - protein, 15 aa, Artificial sequence
  Synthetic peptide
VQTPLLRATVASSTQ

SEQ ID NO: 3669 - protein, 15 aa, Artificial sequence
  Synthetic peptide
QTPLLRATVASSTQK

SEQ ID NO: 3670 - protein, 15 aa, Artificial sequence
  Synthetic peptide
TPLLRATVASSTQKF

SEQ ID NO: 3671 - protein, 15 aa, Artificial sequence
  Synthetic peptide
PLLRATVASSTQKFQ

SEQ ID NO: 3672 - protein, 15 aa, Artificial sequence
  Synthetic peptide
LLRATVASSTQKFQD

SEQ ID NO: 3673 - protein, 15 aa, Artificial sequence
  Synthetic peptide
LRATVASSTQKFQDL

SEQ ID NO: 3674 - protein, 15 aa, Artificial sequence
  Synthetic peptide
RATVASSTQKFQDLG

SEQ ID NO: 3675 - protein, 15 aa, Artificial sequence
  Synthetic peptide
ATVASSTQKFQDLGV

SEQ ID NO: 3676 - protein, 15 aa, Artificial sequence
  Synthetic peptide
TVASSTQKFQDLGVK

SEQ ID NO: 3677 - protein, 15 aa, Artificial sequence
  Synthetic peptide
VASSTQKFQDLGVKN

SEQ ID NO: 3678 - protein, 15 aa, Artificial sequence
  Synthetic peptide
ASSTQKFQDLGVKNS

SEQ ID NO: 3679 - protein, 15 aa, Artificial sequence
  Synthetic peptide
SSTQKFQDLGVKNSE

SEQ ID NO: 3680 - protein, 15 aa, Artificial sequence
  Synthetic peptide
STQKFQDLGVKNSEP

SEQ ID NO: 3681 - protein, 15 aa, Artificial sequence
  Synthetic peptide
TQKFQDLGVKNSEPS

SEQ ID NO: 3682 - protein, 15 aa, Artificial sequence
  Synthetic peptide
QKFQDLGVKNSEPSA

SEQ ID NO: 3683 - protein, 15 aa, Artificial sequence
  Synthetic peptide
KFQDLGVKNSEPSAR

SEQ ID NO: 3684 - protein, 15 aa, Artificial sequence
  Synthetic peptide
FQDLGVKNSEPSARH

SEQ ID NO: 3685 - protein, 15 aa, Artificial sequence
  Synthetic peptide
QDLGVKNSEPSARHV

SEQ ID NO: 3686 - protein, 15 aa, Artificial sequence
  Synthetic peptide
DLGVKNSEPSARHVD

SEQ ID NO: 3687 - protein, 15 aa, Artificial sequence
  Synthetic peptide
LGVKNSEPSARHVDS

SEQ ID NO: 3688 - protein, 15 aa, Artificial sequence
  Synthetic peptide
GVKNSEPSARHVDSL

SEQ ID NO: 3689 - protein, 15 aa, Artificial sequence
  Synthetic peptide
VKNSEPSARHVDSLS

SEQ ID NO: 3690 - protein, 15 aa, Artificial sequence
  Synthetic peptide
KNSEPSARHVDSLSQ

SEQ ID NO: 3691 - protein, 15 aa, Artificial sequence
  Synthetic peptide
NSEPSARHVDSLSQR

SEQ ID NO: 3692 - protein, 15 aa, Artificial sequence
  Synthetic peptide
SEPSARHVDSLSQRS

SEQ ID NO: 3693 - protein, 15 aa, Artificial sequence
  Synthetic peptide
EPSARHVDSLSQRSP

SEQ ID NO: 3694 - protein, 15 aa, Artificial sequence
  Synthetic peptide
PSARHVDSLSQRSPK

SEQ ID NO: 3695 - protein, 15 aa, Artificial sequence
  Synthetic peptide
SARHVDSLSQRSPKA

SEQ ID NO: 3696 - protein, 15 aa, Artificial sequence
  Synthetic peptide
ARHVDSLSQRSPKAS

SEQ ID NO: 3697 - protein, 15 aa, Artificial sequence
  Synthetic peptide
RHVDSLSQRSPKASL

SEQ ID NO: 3698 - protein, 15 aa, Artificial sequence
  Synthetic peptide
HVDSLSQRSPKASLR

SEQ ID NO: 3699 - protein, 15 aa, Artificial sequence
  Synthetic peptide
VDSLSQRSPKASLRR

SEQ ID NO: 3700 - protein, 15 aa, Artificial sequence
  Synthetic peptide
DSLSQRSPKASLRRV

SEQ ID NO: 3701 - protein, 15 aa, Artificial sequence
  Synthetic peptide
SLSQRSPKASLRRVE

SEQ ID NO: 3702 - protein, 15 aa, Artificial sequence
  Synthetic peptide
LSQRSPKASLRRVEL

SEQ ID NO: 3703 - protein, 15 aa, Artificial sequence
  Synthetic peptide
SQRSPKASLRRVELS

SEQ ID NO: 3704 - protein, 15 aa, Artificial sequence
  Synthetic peptide
QRSPKASLRRVELSG

SEQ ID NO: 3705 - protein, 15 aa, Artificial sequence
  Synthetic peptide
RSPKASLRRVELSGP

SEQ ID NO: 3706 - protein, 15 aa, Artificial sequence
  Synthetic peptide
SPKASLRRVELSGPK

SEQ ID NO: 3707 - protein, 15 aa, Artificial sequence
  Synthetic peptide
PKASLRRVELSGPKA

SEQ ID NO: 3708 - protein, 15 aa, Artificial sequence
  Synthetic peptide
KASLRRVELSGPKAA

SEQ ID NO: 3709 - protein, 15 aa, Artificial sequence
  Synthetic peptide
ASLRRVELSGPKAAE

SEQ ID NO: 3710 - protein, 15 aa, Artificial sequence
  Synthetic peptide
SLRRVELSGPKAAEP

SEQ ID NO: 3711 - protein, 15 aa, Artificial sequence
  Synthetic peptide
LRRVELSGPKAAEPV

SEQ ID NO: 3712 - protein, 15 aa, Artificial sequence
  Synthetic peptide
RRVELSGPKAAEPVS

SEQ ID NO: 3713 - protein, 15 aa, Artificial sequence
  Synthetic peptide
RVELSGPKAAEPVSR

SEQ ID NO: 3714 - protein, 15 aa, Artificial sequence
  Synthetic peptide
VELSGPKAAEPVSRR

SEQ ID NO: 3715 - protein, 15 aa, Artificial sequence
  Synthetic peptide
ELSGPKAAEPVSRRT

SEQ ID NO: 3716 - protein, 15 aa, Artificial sequence
  Synthetic peptide
LSGPKAAEPVSRRTE

SEQ ID NO: 3717 - protein, 15 aa, Artificial sequence
  Synthetic peptide
SGPKAAEPVSRRTEL

SEQ ID NO: 3718 - protein, 15 aa, Artificial sequence
  Synthetic peptide
GPKAAEPVSRRTELS

SEQ ID NO: 3719 - protein, 15 aa, Artificial sequence
  Synthetic peptide
PKAAEPVSRRTELSI

SEQ ID NO: 3720 - protein, 15 aa, Artificial sequence
  Synthetic peptide
KAAEPVSRRTELSID

SEQ ID NO: 3721 - protein, 15 aa, Artificial sequence
  Synthetic peptide
AAEPVSRRTELSIDI

SEQ ID NO: 3722 - protein, 15 aa, Artificial sequence
  Synthetic peptide
AEPVSRRTELSIDIS

SEQ ID NO: 3723 - protein, 15 aa, Artificial sequence
  Synthetic peptide
EPVSRRTELSIDISS

SEQ ID NO: 3724 - protein, 15 aa, Artificial sequence
  Synthetic peptide
PVSRRTELSIDISSK

SEQ ID NO: 3725 - protein, 15 aa, Artificial sequence
  Synthetic peptide
VSRRTELSIDISSKQ

SEQ ID NO: 3726 - protein, 15 aa, Artificial sequence
  Synthetic peptide
SRRTELSIDISSKQV

SEQ ID NO: 3727 - protein, 15 aa, Artificial sequence
  Synthetic peptide
RRTELSIDISSKQVE

SEQ ID NO: 3728 - protein, 15 aa, Artificial sequence
  Synthetic peptide
RTELSIDISSKQVEN

SEQ ID NO: 3729 - protein, 15 aa, Artificial sequence
  Synthetic peptide
TELSIDISSKQVENA

SEQ ID NO: 3730 - protein, 15 aa, Artificial sequence
  Synthetic peptide
ELSIDISSKQVENAG

SEQ ID NO: 3731 - protein, 15 aa, Artificial sequence
  Synthetic peptide
LSIDISSKQVENAGA

SEQ ID NO: 3732 - protein, 15 aa, Artificial sequence
  Synthetic peptide
SIDISSKQVENAGAI

SEQ ID NO: 3733 - protein, 15 aa, Artificial sequence
  Synthetic peptide
IDISSKQVENAGAIG

SEQ ID NO: 3734 - protein, 15 aa, Artificial sequence
  Synthetic peptide
DISSKQVENAGAIGP

SEQ ID NO: 3735 - protein, 15 aa, Artificial sequence
  Synthetic peptide
ISSKQVENAGAIGPS

SEQ ID NO: 3736 - protein, 15 aa, Artificial sequence
  Synthetic peptide
SSKQVENAGAIGPSR

SEQ ID NO: 3737 - protein, 15 aa, Artificial sequence
  Synthetic peptide
SKQVENAGAIGPSRF

SEQ ID NO: 3738 - protein, 15 aa, Artificial sequence
  Synthetic peptide
KQVENAGAIGPSRFG

SEQ ID NO: 3739 - protein, 15 aa, Artificial sequence
  Synthetic peptide
QVENAGAIGPSRFGL

SEQ ID NO: 3740 - protein, 15 aa, Artificial sequence
  Synthetic peptide
VENAGAIGPSRFGLK

SEQ ID NO: 3741 - protein, 15 aa, Artificial sequence
  Synthetic peptide
ENAGAIGPSRFGLKR

SEQ ID NO: 3742 - protein, 15 aa, Artificial sequence
  Synthetic peptide
NAGAIGPSRFGLKRA

SEQ ID NO: 3743 - protein, 15 aa, Artificial sequence
  Synthetic peptide
AGAIGPSRFGLKRAE

SEQ ID NO: 3744 - protein, 15 aa, Artificial sequence
  Synthetic peptide
GAIGPSRFGLKRAEV

SEQ ID NO: 3745 - protein, 15 aa, Artificial sequence
  Synthetic peptide
AIGPSRFGLKRAEVL

SEQ ID NO: 3746 - protein, 15 aa, Artificial sequence
  Synthetic peptide
IGPSRFGLKRAEVLG

SEQ ID NO: 3747 - protein, 15 aa, Artificial sequence
  Synthetic peptide
GPSRFGLKRAEVLGH

SEQ ID NO: 3748 - protein, 15 aa, Artificial sequence
  Synthetic peptide
PSRFGLKRAEVLGHK

SEQ ID NO: 3749 - protein, 15 aa, Artificial sequence
  Synthetic peptide
SRFGLKRAEVLGHKT

SEQ ID NO: 3750 - protein, 15 aa, Artificial sequence
  Synthetic peptide
RFGLKRAEVLGHKTP

SEQ ID NO: 3751 - protein, 15 aa, Artificial sequence
  Synthetic peptide
FGLKRAEVLGHKTPE

SEQ ID NO: 3752 - protein, 15 aa, Artificial sequence
  Synthetic peptide
GLKRAEVLGHKTPEP

SEQ ID NO: 3753 - protein, 15 aa, Artificial sequence
  Synthetic peptide
LKRAEVLGHKTPEPA

SEQ ID NO: 3754 - protein, 15 aa, Artificial sequence
  Synthetic peptide
KRAEVLGHKTPEPAP

SEQ ID NO: 3755 - protein, 15 aa, Artificial sequence
  Synthetic peptide
RAEVLGHKTPEPAPR

SEQ ID NO: 3756 - protein, 15 aa, Artificial sequence
  Synthetic peptide
AEVLGHKTPEPAPRR

SEQ ID NO: 3757 - protein, 15 aa, Artificial sequence
  Synthetic peptide
EVLGHKTPEPAPRRT

SEQ ID NO: 3758 - protein, 15 aa, Artificial sequence
  Synthetic peptide
VLGHKTPEPAPRRTE

SEQ ID NO: 3759 - protein, 15 aa, Artificial sequence
  Synthetic peptide
LGHKTPEPAPRRTEI

SEQ ID NO: 3760 - protein, 15 aa, Artificial sequence
  Synthetic peptide
GHKTPEPAPRRTEIT

SEQ ID NO: 3761 - protein, 15 aa, Artificial sequence
  Synthetic peptide
HKTPEPAPRRTEITI

SEQ ID NO: 3762 - protein, 15 aa, Artificial sequence
  Synthetic peptide
KTPEPAPRRTEITIV

SEQ ID NO: 3763 - protein, 15 aa, Artificial sequence
  Synthetic peptide
TPEPAPRRTEITIVK

SEQ ID NO: 3764 - protein, 15 aa, Artificial sequence
  Synthetic peptide
PEPAPRRTEITIVKP

SEQ ID NO: 3765 - protein, 15 aa, Artificial sequence
  Synthetic peptide
EPAPRRTEITIVKPQ

SEQ ID NO: 3766 - protein, 15 aa, Artificial sequence
  Synthetic peptide
PAPRRTEITIVKPQE

SEQ ID NO: 3767 - protein, 15 aa, Artificial sequence
  Synthetic peptide
APRRTEITIVKPQES

SEQ ID NO: 3768 - protein, 15 aa, Artificial sequence
  Synthetic peptide
PRRTEITIVKPQESA

SEQ ID NO: 3769 - protein, 15 aa, Artificial sequence
  Synthetic peptide
RRTEITIVKPQESAH

SEQ ID NO: 3770 - protein, 15 aa, Artificial sequence
  Synthetic peptide
RTEITIVKPQESAHR

SEQ ID NO: 3771 - protein, 15 aa, Artificial sequence
  Synthetic peptide
TEITIVKPQESAHRR

SEQ ID NO: 3772 - protein, 15 aa, Artificial sequence
  Synthetic peptide
EITIVKPQESAHRRM

SEQ ID NO: 3773 - protein, 15 aa, Artificial sequence
  Synthetic peptide
ITIVKPQESAHRRME

SEQ ID NO: 3774 - protein, 15 aa, Artificial sequence
  Synthetic peptide
TIVKPQESAHRRMEP

SEQ ID NO: 3775 - protein, 15 aa, Artificial sequence
  Synthetic peptide
IVKPQESAHRRMEPP

SEQ ID NO: 3776 - protein, 15 aa, Artificial sequence
  Synthetic peptide
VKPQESAHRRMEPPA

SEQ ID NO: 3777 - protein, 15 aa, Artificial sequence
  Synthetic peptide
KPQESAHRRMEPPAS

SEQ ID NO: 3778 - protein, 15 aa, Artificial sequence
  Synthetic peptide
PQESAHRRMEPPASK

SEQ ID NO: 3779 - protein, 15 aa, Artificial sequence
  Synthetic peptide
QESAHRRMEPPASKV

SEQ ID NO: 3780 - protein, 15 aa, Artificial sequence
  Synthetic peptide
ESAHRRMEPPASKVP

SEQ ID NO: 3781 - protein, 15 aa, Artificial sequence
  Synthetic peptide
SAHRRMEPPASKVPE

SEQ ID NO: 3782 - protein, 15 aa, Artificial sequence
  Synthetic peptide
AHRRMEPPASKVPEV

SEQ ID NO: 3783 - protein, 15 aa, Artificial sequence
  Synthetic peptide
HRRMEPPASKVPEVP

SEQ ID NO: 3784 - protein, 15 aa, Artificial sequence
  Synthetic peptide
RRMEPPASKVPEVPT

SEQ ID NO: 3785 - protein, 15 aa, Artificial sequence
  Synthetic peptide
RMEPPASKVPEVPTA

SEQ ID NO: 3786 - protein, 15 aa, Artificial sequence
  Synthetic peptide
MEPPASKVPEVPTAP

SEQ ID NO: 3787 - protein, 15 aa, Artificial sequence
  Synthetic peptide
EPPASKVPEVPTAPA

SEQ ID NO: 3788 - protein, 15 aa, Artificial sequence
  Synthetic peptide
PPASKVPEVPTAPAT

SEQ ID NO: 3789 - protein, 15 aa, Artificial sequence
  Synthetic peptide
PASKVPEVPTAPATD

SEQ ID NO: 3790 - protein, 15 aa, Artificial sequence
  Synthetic peptide
ASKVPEVPTAPATDA

SEQ ID NO: 3791 - protein, 15 aa, Artificial sequence
  Synthetic peptide
SKVPEVPTAPATDAA

SEQ ID NO: 3792 - protein, 15 aa, Artificial sequence
  Synthetic peptide
KVPEVPTAPATDAAP

SEQ ID NO: 3793 - protein, 15 aa, Artificial sequence
  Synthetic peptide
VPEVPTAPATDAAPK

SEQ ID NO: 3794 - protein, 15 aa, Artificial sequence
  Synthetic peptide
PEVPTAPATDAAPKR

SEQ ID NO: 3795 - protein, 15 aa, Artificial sequence
  Synthetic peptide
EVPTAPATDAAPKRV

SEQ ID NO: 3796 - protein, 15 aa, Artificial sequence
  Synthetic peptide
VPTAPATDAAPKRVE

SEQ ID NO: 3797 - protein, 15 aa, Artificial sequence
  Synthetic peptide
PTAPATDAAPKRVEI

SEQ ID NO: 3798 - protein, 15 aa, Artificial sequence
  Synthetic peptide
TAPATDAAPKRVEIQ

SEQ ID NO: 3799 - protein, 15 aa, Artificial sequence
  Synthetic peptide
APATDAAPKRVEIQM

SEQ ID NO: 3800 - protein, 15 aa, Artificial sequence
  Synthetic peptide
PATDAAPKRVEIQMP

SEQ ID NO: 3801 - protein, 15 aa, Artificial sequence
  Synthetic peptide
ATDAAPKRVEIQMPK

SEQ ID NO: 3802 - protein, 15 aa, Artificial sequence
  Synthetic peptide
TDAAPKRVEIQMPKP

SEQ ID NO: 3803 - protein, 15 aa, Artificial sequence
  Synthetic peptide
DAAPKRVEIQMPKPA

SEQ ID NO: 3804 - protein, 15 aa, Artificial sequence
  Synthetic peptide
AAPKRVEIQMPKPAE

SEQ ID NO: 3805 - protein, 15 aa, Artificial sequence
  Synthetic peptide
APKRVEIQMPKPAEA

SEQ ID NO: 3806 - protein, 15 aa, Artificial sequence
  Synthetic peptide
PKRVEIQMPKPAEAP

SEQ ID NO: 3807 - protein, 15 aa, Artificial sequence
  Synthetic peptide
KRVEIQMPKPAEAPT

SEQ ID NO: 3808 - protein, 15 aa, Artificial sequence
  Synthetic peptide
RVEIQMPKPAEAPTA

SEQ ID NO: 3809 - protein, 15 aa, Artificial sequence
  Synthetic peptide
VEIQMPKPAEAPTAP

SEQ ID NO: 3810 - protein, 15 aa, Artificial sequence
  Synthetic peptide
EIQMPKPAEAPTAPS

SEQ ID NO: 3811 - protein, 15 aa, Artificial sequence
  Synthetic peptide
IQMPKPAEAPTAPSP

SEQ ID NO: 3812 - protein, 15 aa, Artificial sequence
  Synthetic peptide
QMPKPAEAPTAPSPA

SEQ ID NO: 3813 - protein, 15 aa, Artificial sequence
  Synthetic peptide
MPKPAEAPTAPSPAQ

SEQ ID NO: 3814 - protein, 15 aa, Artificial sequence
  Synthetic peptide
PKPAEAPTAPSPAQT

SEQ ID NO: 3815 - protein, 15 aa, Artificial sequence
  Synthetic peptide
KPAEAPTAPSPAQTL

SEQ ID NO: 3816 - protein, 15 aa, Artificial sequence
  Synthetic peptide
PAEAPTAPSPAQTLE

SEQ ID NO: 3817 - protein, 15 aa, Artificial sequence
  Synthetic peptide
AEAPTAPSPAQTLEN

SEQ ID NO: 3818 - protein, 15 aa, Artificial sequence
  Synthetic peptide
EAPTAPSPAQTLENS

SEQ ID NO: 3819 - protein, 15 aa, Artificial sequence
  Synthetic peptide
APTAPSPAQTLENSE

SEQ ID NO: 3820 - protein, 15 aa, Artificial sequence
  Synthetic peptide
PTAPSPAQTLENSEP

SEQ ID NO: 3821 - protein, 15 aa, Artificial sequence
  Synthetic peptide
TAPSPAQTLENSEPA

SEQ ID NO: 3822 - protein, 15 aa, Artificial sequence
  Synthetic peptide
APSPAQTLENSEPAP

SEQ ID NO: 3823 - protein, 15 aa, Artificial sequence
  Synthetic peptide
PSPAQTLENSEPAPV

SEQ ID NO: 3824 - protein, 15 aa, Artificial sequence
  Synthetic peptide
SPAQTLENSEPAPVS

SEQ ID NO: 3825 - protein, 15 aa, Artificial sequence
  Synthetic peptide
PAQTLENSEPAPVSQ

SEQ ID NO: 3826 - protein, 15 aa, Artificial sequence
  Synthetic peptide
AQTLENSEPAPVSQL

SEQ ID NO: 3827 - protein, 15 aa, Artificial sequence
  Synthetic peptide
QTLENSEPAPVSQLQ

SEQ ID NO: 3828 - protein, 15 aa, Artificial sequence
  Synthetic peptide
TLENSEPAPVSQLQS

SEQ ID NO: 3829 - protein, 15 aa, Artificial sequence
  Synthetic peptide
LENSEPAPVSQLQSR

SEQ ID NO: 3830 - protein, 15 aa, Artificial sequence
  Synthetic peptide
ENSEPAPVSQLQSRL

SEQ ID NO: 3831 - protein, 15 aa, Artificial sequence
  Synthetic peptide
NSEPAPVSQLQSRLE

SEQ ID NO: 3832 - protein, 15 aa, Artificial sequence
  Synthetic peptide
SEPAPVSQLQSRLEP

SEQ ID NO: 3833 - protein, 15 aa, Artificial sequence
  Synthetic peptide
EPAPVSQLQSRLEPK

SEQ ID NO: 3834 - protein, 15 aa, Artificial sequence
  Synthetic peptide
PAPVSQLQSRLEPKP

SEQ ID NO: 3835 - protein, 15 aa, Artificial sequence
  Synthetic peptide
APVSQLQSRLEPKPQ

SEQ ID NO: 3836 - protein, 15 aa, Artificial sequence
  Synthetic peptide
PVSQLQSRLEPKPQP

SEQ ID NO: 3837 - protein, 15 aa, Artificial sequence
  Synthetic peptide
VSQLQSRLEPKPQPP

SEQ ID NO: 3838 - protein, 15 aa, Artificial sequence
  Synthetic peptide
SQLQSRLEPKPQPPV

SEQ ID NO: 3839 - protein, 15 aa, Artificial sequence
  Synthetic peptide
QLQSRLEPKPQPPVA

SEQ ID NO: 3840 - protein, 15 aa, Artificial sequence
  Synthetic peptide
LQSRLEPKPQPPVAE

SEQ ID NO: 3841 - protein, 15 aa, Artificial sequence
  Synthetic peptide
QSRLEPKPQPPVAEA

SEQ ID NO: 3842 - protein, 15 aa, Artificial sequence
  Synthetic peptide
SRLEPKPQPPVAEAT

SEQ ID NO: 3843 - protein, 15 aa, Artificial sequence
  Synthetic peptide
RLEPKPQPPVAEATP

SEQ ID NO: 3844 - protein, 15 aa, Artificial sequence
  Synthetic peptide
LEPKPQPPVAEATPR

SEQ ID NO: 3845 - protein, 15 aa, Artificial sequence
  Synthetic peptide
EPKPQPPVAEATPRS

SEQ ID NO: 3846 - protein, 15 aa, Artificial sequence
  Synthetic peptide
PKPQPPVAEATPRSQ

SEQ ID NO: 3847 - protein, 15 aa, Artificial sequence
  Synthetic peptide
KPQPPVAEATPRSQE

SEQ ID NO: 3848 - protein, 15 aa, Artificial sequence
  Synthetic peptide
PQPPVAEATPRSQEA

SEQ ID NO: 3849 - protein, 15 aa, Artificial sequence
  Synthetic peptide
QPPVAEATPRSQEAT

SEQ ID NO: 3850 - protein, 15 aa, Artificial sequence
  Synthetic peptide
PPVAEATPRSQEATE

SEQ ID NO: 3851 - protein, 15 aa, Artificial sequence
  Synthetic peptide
PVAEATPRSQEATEA

SEQ ID NO: 3852 - protein, 15 aa, Artificial sequence
  Synthetic peptide
VAEATPRSQEATEAA

SEQ ID NO: 3853 - protein, 15 aa, Artificial sequence
  Synthetic peptide
AEATPRSQEATEAAP

SEQ ID NO: 3854 - protein, 15 aa, Artificial sequence
  Synthetic peptide
EATPRSQEATEAAPS

SEQ ID NO: 3855 - protein, 15 aa, Artificial sequence
  Synthetic peptide
ATPRSQEATEAAPSC

SEQ ID NO: 3856 - protein, 15 aa, Artificial sequence
  Synthetic peptide
TPRSQEATEAAPSCV

SEQ ID NO: 3857 - protein, 15 aa, Artificial sequence
  Synthetic peptide
PRSQEATEAAPSCVG

SEQ ID NO: 3858 - protein, 15 aa, Artificial sequence
  Synthetic peptide
RSQEATEAAPSCVGD

SEQ ID NO: 3859 - protein, 15 aa, Artificial sequence
  Synthetic peptide
SQEATEAAPSCVGDM

SEQ ID NO: 3860 - protein, 15 aa, Artificial sequence
  Synthetic peptide
QEATEAAPSCVGDMA

SEQ ID NO: 3861 - protein, 15 aa, Artificial sequence
  Synthetic peptide
EATEAAPSCVGDMAD

SEQ ID NO: 3862 - protein, 15 aa, Artificial sequence
  Synthetic peptide
ATEAAPSCVGDMADT

SEQ ID NO: 3863 - protein, 15 aa, Artificial sequence
  Synthetic peptide
TEAAPSCVGDMADTP

SEQ ID NO: 3864 - protein, 15 aa, Artificial sequence
  Synthetic peptide
EAAPSCVGDMADTPR

SEQ ID NO: 3865 - protein, 15 aa, Artificial sequence
  Synthetic peptide
AAPSCVGDMADTPRD

SEQ ID NO: 3866 - protein, 15 aa, Artificial sequence
  Synthetic peptide
APSCVGDMADTPRDA

SEQ ID NO: 3867 - protein, 15 aa, Artificial sequence
  Synthetic peptide
PSCVGDMADTPRDAG

SEQ ID NO: 3868 - protein, 15 aa, Artificial sequence
  Synthetic peptide
SCVGDMADTPRDAGL

SEQ ID NO: 3869 - protein, 15 aa, Artificial sequence
  Synthetic peptide
CVGDMADTPRDAGLK

SEQ ID NO: 3870 - protein, 15 aa, Artificial sequence
  Synthetic peptide
VGDMADTPRDAGLKQ

SEQ ID NO: 3871 - protein, 15 aa, Artificial sequence
  Synthetic peptide
GDMADTPRDAGLKQA

SEQ ID NO: 3872 - protein, 15 aa, Artificial sequence
  Synthetic peptide
DMADTPRDAGLKQAP

SEQ ID NO: 3873 - protein, 15 aa, Artificial sequence
  Synthetic peptide
MADTPRDAGLKQAPA

SEQ ID NO: 3874 - protein, 15 aa, Artificial sequence
  Synthetic peptide
ADTPRDAGLKQAPAS

SEQ ID NO: 3875 - protein, 15 aa, Artificial sequence
  Synthetic peptide
DTPRDAGLKQAPASR

SEQ ID NO: 3876 - protein, 15 aa, Artificial sequence
  Synthetic peptide
TPRDAGLKQAPASRN

SEQ ID NO: 3877 - protein, 15 aa, Artificial sequence
  Synthetic peptide
PRDAGLKQAPASRNE

SEQ ID NO: 3878 - protein, 15 aa, Artificial sequence
  Synthetic peptide
RDAGLKQAPASRNEK

SEQ ID NO: 3879 - protein, 15 aa, Artificial sequence
  Synthetic peptide
DAGLKQAPASRNEKA

SEQ ID NO: 3880 - protein, 15 aa, Artificial sequence
  Synthetic peptide
AGLKQAPASRNEKAP

SEQ ID NO: 3881 - protein, 15 aa, Artificial sequence
  Synthetic peptide
GLKQAPASRNEKAPV

SEQ ID NO: 3882 - protein, 15 aa, Artificial sequence
  Synthetic peptide
LKQAPASRNEKAPVD

SEQ ID NO: 3883 - protein, 15 aa, Artificial sequence
  Synthetic peptide
KQAPASRNEKAPVDF

SEQ ID NO: 3884 - protein, 15 aa, Artificial sequence
  Synthetic peptide
QAPASRNEKAPVDFG

SEQ ID NO: 3885 - protein, 15 aa, Artificial sequence
  Synthetic peptide
APASRNEKAPVDFGY

SEQ ID NO: 3886 - protein, 15 aa, Artificial sequence
  Synthetic peptide
PASRNEKAPVDFGYV

SEQ ID NO: 3887 - protein, 15 aa, Artificial sequence
  Synthetic peptide
ASRNEKAPVDFGYVG

SEQ ID NO: 3888 - protein, 15 aa, Artificial sequence
  Synthetic peptide
SRNEKAPVDFGYVGI

SEQ ID NO: 3889 - protein, 15 aa, Artificial sequence
  Synthetic peptide
RNEKAPVDFGYVGID

SEQ ID NO: 3890 - protein, 15 aa, Artificial sequence
  Synthetic peptide
NEKAPVDFGYVGIDS

SEQ ID NO: 3891 - protein, 15 aa, Artificial sequence
  Synthetic peptide
EKAPVDFGYVGIDSI

SEQ ID NO: 3892 - protein, 15 aa, Artificial sequence
  Synthetic peptide
KAPVDFGYVGIDSIL

SEQ ID NO: 3893 - protein, 15 aa, Artificial sequence
  Synthetic peptide
APVDFGYVGIDSILE

SEQ ID NO: 3894 - protein, 15 aa, Artificial sequence
  Synthetic peptide
PVDFGYVGIDSILEQ

SEQ ID NO: 3895 - protein, 15 aa, Artificial sequence
  Synthetic peptide
VDFGYVGIDSILEQM

SEQ ID NO: 3896 - protein, 15 aa, Artificial sequence
  Synthetic peptide
DFGYVGIDSILEQMR

SEQ ID NO: 3897 - protein, 15 aa, Artificial sequence
  Synthetic peptide
FGYVGIDSILEQMRR

SEQ ID NO: 3898 - protein, 15 aa, Artificial sequence
  Synthetic peptide
GYVGIDSILEQMRRK

SEQ ID NO: 3899 - protein, 15 aa, Artificial sequence
  Synthetic peptide
YVGIDSILEQMRRKA

SEQ ID NO: 3900 - protein, 15 aa, Artificial sequence
  Synthetic peptide
VGIDSILEQMRRKAM

SEQ ID NO: 3901 - protein, 15 aa, Artificial sequence
  Synthetic peptide
GIDSILEQMRRKAMK

SEQ ID NO: 3902 - protein, 15 aa, Artificial sequence
  Synthetic peptide
IDSILEQMRRKAMKQ

SEQ ID NO: 3903 - protein, 15 aa, Artificial sequence
  Synthetic peptide
DSILEQMRRKAMKQG

SEQ ID NO: 3904 - protein, 15 aa, Artificial sequence
  Synthetic peptide
SILEQMRRKAMKQGF

SEQ ID NO: 3905 - protein, 15 aa, Artificial sequence
  Synthetic peptide
ILEQMRRKAMKQGFE

SEQ ID NO: 3906 - protein, 15 aa, Artificial sequence
  Synthetic peptide
LEQMRRKAMKQGFEF

SEQ ID NO: 3907 - protein, 15 aa, Artificial sequence
  Synthetic peptide
EQMRRKAMKQGFEFN

SEQ ID NO: 3908 - protein, 15 aa, Artificial sequence
  Synthetic peptide
QMRRKAMKQGFEFNI

SEQ ID NO: 3909 - protein, 15 aa, Artificial sequence
  Synthetic peptide
MRRKAMKQGFEFNIM

SEQ ID NO: 3910 - protein, 15 aa, Artificial sequence
  Synthetic peptide
RRKAMKQGFEFNIMV

SEQ ID NO: 3911 - protein, 15 aa, Artificial sequence
  Synthetic peptide
RKAMKQGFEFNIMVV

SEQ ID NO: 3912 - protein, 15 aa, Artificial sequence
  Synthetic peptide
KAMKQGFEFNIMVVG

SEQ ID NO: 3913 - protein, 15 aa, Artificial sequence
  Synthetic peptide
AMKQGFEFNIMVVGQ

SEQ ID NO: 3914 - protein, 15 aa, Artificial sequence
  Synthetic peptide
MKQGFEFNIMVVGQS

SEQ ID NO: 3915 - protein, 15 aa, Artificial sequence
  Synthetic peptide
KQGFEFNIMVVGQSG

SEQ ID NO: 3916 - protein, 15 aa, Artificial sequence
  Synthetic peptide
QGFEFNIMVVGQSGL

SEQ ID NO: 3917 - protein, 15 aa, Artificial sequence
  Synthetic peptide
GFEFNIMVVGQSGLG

SEQ ID NO: 3918 - protein, 15 aa, Artificial sequence
  Synthetic peptide
FEFNIMVVGQSGLGK

SEQ ID NO: 3919 - protein, 15 aa, Artificial sequence
  Synthetic peptide
EFNIMVVGQSGLGKS

SEQ ID NO: 3920 - protein, 15 aa, Artificial sequence
  Synthetic peptide
FNIMVVGQSGLGKST

SEQ ID NO: 3921 - protein, 15 aa, Artificial sequence
  Synthetic peptide
NIMVVGQSGLGKSTL

SEQ ID NO: 3922 - protein, 15 aa, Artificial sequence
  Synthetic peptide
IMVVGQSGLGKSTLI

SEQ ID NO: 3923 - protein, 15 aa, Artificial sequence
  Synthetic peptide
MVVGQSGLGKSTLIN

SEQ ID NO: 3924 - protein, 15 aa, Artificial sequence
  Synthetic peptide
VVGQSGLGKSTLINT

SEQ ID NO: 3925 - protein, 15 aa, Artificial sequence
  Synthetic peptide
VGQSGLGKSTLINTL

SEQ ID NO: 3926 - protein, 15 aa, Artificial sequence
  Synthetic peptide
GQSGLGKSTLINTLF

SEQ ID NO: 3927 - protein, 15 aa, Artificial sequence
  Synthetic peptide
QSGLGKSTLINTLFK

SEQ ID NO: 3928 - protein, 15 aa, Artificial sequence
  Synthetic peptide
SGLGKSTLINTLFKS

SEQ ID NO: 3929 - protein, 15 aa, Artificial sequence
  Synthetic peptide
GLGKSTLINTLFKSK

SEQ ID NO: 3930 - protein, 15 aa, Artificial sequence
  Synthetic peptide
LGKSTLINTLFKSKI

SEQ ID NO: 3931 - protein, 15 aa, Artificial sequence
  Synthetic peptide
GKSTLINTLFKSKIS

SEQ ID NO: 3932 - protein, 15 aa, Artificial sequence
  Synthetic peptide
KSTLINTLFKSKISR

SEQ ID NO: 3933 - protein, 15 aa, Artificial sequence
  Synthetic peptide
STLINTLFKSKISRK

SEQ ID NO: 3934 - protein, 15 aa, Artificial sequence
  Synthetic peptide
TLINTLFKSKISRKS

SEQ ID NO: 3935 - protein, 15 aa, Artificial sequence
  Synthetic peptide
LINTLFKSKISRKSV

SEQ ID NO: 3936 - protein, 15 aa, Artificial sequence
  Synthetic peptide
INTLFKSKISRKSVQ

SEQ ID NO: 3937 - protein, 15 aa, Artificial sequence
  Synthetic peptide
NTLFKSKISRKSVQP

SEQ ID NO: 3938 - protein, 15 aa, Artificial sequence
  Synthetic peptide
TLFKSKISRKSVQPT

SEQ ID NO: 3939 - protein, 15 aa, Artificial sequence
  Synthetic peptide
LFKSKISRKSVQPTS

SEQ ID NO: 3940 - protein, 15 aa, Artificial sequence
  Synthetic peptide
FKSKISRKSVQPTSE

SEQ ID NO: 3941 - protein, 15 aa, Artificial sequence
  Synthetic peptide
KSKISRKSVQPTSEE

SEQ ID NO: 3942 - protein, 15 aa, Artificial sequence
  Synthetic peptide
SKISRKSVQPTSEER

SEQ ID NO: 3943 - protein, 15 aa, Artificial sequence
  Synthetic peptide
KISRKSVQPTSEERI

SEQ ID NO: 3944 - protein, 15 aa, Artificial sequence
  Synthetic peptide
ISRKSVQPTSEERIP

SEQ ID NO: 3945 - protein, 15 aa, Artificial sequence
  Synthetic peptide
SRKSVQPTSEERIPK

SEQ ID NO: 3946 - protein, 15 aa, Artificial sequence
  Synthetic peptide
RKSVQPTSEERIPKT

SEQ ID NO: 3947 - protein, 15 aa, Artificial sequence
  Synthetic peptide
KSVQPTSEERIPKTI

SEQ ID NO: 3948 - protein, 15 aa, Artificial sequence
  Synthetic peptide
SVQPTSEERIPKTIE

SEQ ID NO: 3949 - protein, 15 aa, Artificial sequence
  Synthetic peptide
VQPTSEERIPKTIEI

SEQ ID NO: 3950 - protein, 15 aa, Artificial sequence
  Synthetic peptide
QPTSEERIPKTIEIK

SEQ ID NO: 3951 - protein, 15 aa, Artificial sequence
  Synthetic peptide
PTSEERIPKTIEIKS

SEQ ID NO: 3952 - protein, 15 aa, Artificial sequence
  Synthetic peptide
TSEERIPKTIEIKSI

SEQ ID NO: 3953 - protein, 15 aa, Artificial sequence
  Synthetic peptide
SEERIPKTIEIKSIT

SEQ ID NO: 3954 - protein, 15 aa, Artificial sequence
  Synthetic peptide
EERIPKTIEIKSITH

SEQ ID NO: 3955 - protein, 15 aa, Artificial sequence
  Synthetic peptide
ERIPKTIEIKSITHD

SEQ ID NO: 3956 - protein, 15 aa, Artificial sequence
  Synthetic peptide
RIPKTIEIKSITHDI

SEQ ID NO: 3957 - protein, 15 aa, Artificial sequence
  Synthetic peptide
IPKTIEIKSITHDIE

SEQ ID NO: 3958 - protein, 15 aa, Artificial sequence
  Synthetic peptide
PKTIEIKSITHDIEE

SEQ ID NO: 3959 - protein, 15 aa, Artificial sequence
  Synthetic peptide
KTIEIKSITHDIEEK

SEQ ID NO: 3960 - protein, 15 aa, Artificial sequence
  Synthetic peptide
TIEIKSITHDIEEKG

SEQ ID NO: 3961 - protein, 15 aa, Artificial sequence
  Synthetic peptide
IEIKSITHDIEEKGV

SEQ ID NO: 3962 - protein, 15 aa, Artificial sequence
  Synthetic peptide
EIKSITHDIEEKGVR

SEQ ID NO: 3963 - protein, 15 aa, Artificial sequence
  Synthetic peptide
IKSITHDIEEKGVRM

SEQ ID NO: 3964 - protein, 15 aa, Artificial sequence
  Synthetic peptide
KSITHDIEEKGVRMK

SEQ ID NO: 3965 - protein, 15 aa, Artificial sequence
  Synthetic peptide
SITHDIEEKGVRMKL

SEQ ID NO: 3966 - protein, 15 aa, Artificial sequence
  Synthetic peptide
ITHDIEEKGVRMKLT

SEQ ID NO: 3967 - protein, 15 aa, Artificial sequence
  Synthetic peptide
THDIEEKGVRMKLTV

SEQ ID NO: 3968 - protein, 15 aa, Artificial sequence
  Synthetic peptide
HDIEEKGVRMKLTVI

SEQ ID NO: 3969 - protein, 15 aa, Artificial sequence
  Synthetic peptide
DIEEKGVRMKLTVID

SEQ ID NO: 3970 - protein, 15 aa, Artificial sequence
  Synthetic peptide
IEEKGVRMKLTVIDT

SEQ ID NO: 3971 - protein, 15 aa, Artificial sequence
  Synthetic peptide
EEKGVRMKLTVIDTP

SEQ ID NO: 3972 - protein, 15 aa, Artificial sequence
  Synthetic peptide
EKGVRMKLTVIDTPG

SEQ ID NO: 3973 - protein, 15 aa, Artificial sequence
  Synthetic peptide
KGVRMKLTVIDTPGF

SEQ ID NO: 3974 - protein, 15 aa, Artificial sequence
  Synthetic peptide
GVRMKLTVIDTPGFG

SEQ ID NO: 3975 - protein, 15 aa, Artificial sequence
  Synthetic peptide
VRMKLTVIDTPGFGD

SEQ ID NO: 3976 - protein, 15 aa, Artificial sequence
  Synthetic peptide
RMKLTVIDTPGFGDH

SEQ ID NO: 3977 - protein, 15 aa, Artificial sequence
  Synthetic peptide
MKLTVIDTPGFGDHI

SEQ ID NO: 3978 - protein, 15 aa, Artificial sequence
  Synthetic peptide
KLTVIDTPGFGDHIN

SEQ ID NO: 3979 - protein, 15 aa, Artificial sequence
  Synthetic peptide
LTVIDTPGFGDHINN

SEQ ID NO: 3980 - protein, 15 aa, Artificial sequence
  Synthetic peptide
TVIDTPGFGDHINNE

SEQ ID NO: 3981 - protein, 15 aa, Artificial sequence
  Synthetic peptide
VIDTPGFGDHINNEN

SEQ ID NO: 3982 - protein, 15 aa, Artificial sequence
  Synthetic peptide
IDTPGFGDHINNENC

SEQ ID NO: 3983 - protein, 15 aa, Artificial sequence
  Synthetic peptide
DTPGFGDHINNENCW

SEQ ID NO: 3984 - protein, 15 aa, Artificial sequence
  Synthetic peptide
TPGFGDHINNENCWQ

SEQ ID NO: 3985 - protein, 15 aa, Artificial sequence
  Synthetic peptide
PGFGDHINNENCWQP

SEQ ID NO: 3986 - protein, 15 aa, Artificial sequence
  Synthetic peptide
GFGDHINNENCWQPI

SEQ ID NO: 3987 - protein, 15 aa, Artificial sequence
  Synthetic peptide
FGDHINNENCWQPIM

SEQ ID NO: 3988 - protein, 15 aa, Artificial sequence
  Synthetic peptide
GDHINNENCWQPIMK

SEQ ID NO: 3989 - protein, 15 aa, Artificial sequence
  Synthetic peptide
DHINNENCWQPIMKF

SEQ ID NO: 3990 - protein, 15 aa, Artificial sequence
  Synthetic peptide
HINNENCWQPIMKFI

SEQ ID NO: 3991 - protein, 15 aa, Artificial sequence
  Synthetic peptide
INNENCWQPIMKFIN

SEQ ID NO: 3992 - protein, 15 aa, Artificial sequence
  Synthetic peptide
NNENCWQPIMKFIND

SEQ ID NO: 3993 - protein, 15 aa, Artificial sequence
  Synthetic peptide
NENCWQPIMKFINDQ

SEQ ID NO: 3994 - protein, 15 aa, Artificial sequence
  Synthetic peptide
ENCWQPIMKFINDQY

SEQ ID NO: 3995 - protein, 15 aa, Artificial sequence
  Synthetic peptide
NCWQPIMKFINDQYE

SEQ ID NO: 3996 - protein, 15 aa, Artificial sequence
  Synthetic peptide
CWQPIMKFINDQYEK

SEQ ID NO: 3997 - protein, 15 aa, Artificial sequence
  Synthetic peptide
WQPIMKFINDQYEKY

SEQ ID NO: 3998 - protein, 15 aa, Artificial sequence
  Synthetic peptide
QPIMKFINDQYEKYL

SEQ ID NO: 3999 - protein, 15 aa, Artificial sequence
  Synthetic peptide
PIMKFINDQYEKYLQ

SEQ ID NO: 4000 - protein, 15 aa, Artificial sequence
  Synthetic peptide
IMKFINDQYEKYLQE

SEQ ID NO: 4001 - protein, 15 aa, Artificial sequence
  Synthetic peptide
MKFINDQYEKYLQEE

SEQ ID NO: 4002 - protein, 15 aa, Artificial sequence
  Synthetic peptide
KFINDQYEKYLQEEV

SEQ ID NO: 4003 - protein, 15 aa, Artificial sequence
  Synthetic peptide
FINDQYEKYLQEEVN

SEQ ID NO: 4004 - protein, 15 aa, Artificial sequence
  Synthetic peptide
INDQYEKYLQEEVNI

SEQ ID NO: 4005 - protein, 15 aa, Artificial sequence
  Synthetic peptide
NDQYEKYLQEEVNIN

SEQ ID NO: 4006 - protein, 15 aa, Artificial sequence
  Synthetic peptide
DQYEKYLQEEVNINR

SEQ ID NO: 4007 - protein, 15 aa, Artificial sequence
  Synthetic peptide
QYEKYLQEEVNINRK

SEQ ID NO: 4008 - protein, 15 aa, Artificial sequence
  Synthetic peptide
YEKYLQEEVNINRKK

SEQ ID NO: 4009 - protein, 15 aa, Artificial sequence
  Synthetic peptide
EKYLQEEVNINRKKR

SEQ ID NO: 4010 - protein, 15 aa, Artificial sequence
  Synthetic peptide
KYLQEEVNINRKKRI

SEQ ID NO: 4011 - protein, 15 aa, Artificial sequence
  Synthetic peptide
YLQEEVNINRKKRIP

SEQ ID NO: 4012 - protein, 15 aa, Artificial sequence
  Synthetic peptide
LQEEVNINRKKRIPD

SEQ ID NO: 4013 - protein, 15 aa, Artificial sequence
  Synthetic peptide
QEEVNINRKKRIPDT

SEQ ID NO: 4014 - protein, 15 aa, Artificial sequence
  Synthetic peptide
EEVNINRKKRIPDTR

SEQ ID NO: 4015 - protein, 15 aa, Artificial sequence
  Synthetic peptide
EVNINRKKRIPDTRV

SEQ ID NO: 4016 - protein, 15 aa, Artificial sequence
  Synthetic peptide
VNINRKKRIPDTRVH

SEQ ID NO: 4017 - protein, 15 aa, Artificial sequence
  Synthetic peptide
NINRKKRIPDTRVHC

SEQ ID NO: 4018 - protein, 15 aa, Artificial sequence
  Synthetic peptide
INRKKRIPDTRVHCC

SEQ ID NO: 4019 - protein, 15 aa, Artificial sequence
  Synthetic peptide
NRKKRIPDTRVHCCL

SEQ ID NO: 4020 - protein, 15 aa, Artificial sequence
  Synthetic peptide
RKKRIPDTRVHCCLY

SEQ ID NO: 4021 - protein, 15 aa, Artificial sequence
  Synthetic peptide
KKRIPDTRVHCCLYF

SEQ ID NO: 4022 - protein, 15 aa, Artificial sequence
  Synthetic peptide
KRIPDTRVHCCLYFI

SEQ ID NO: 4023 - protein, 15 aa, Artificial sequence
  Synthetic peptide
RIPDTRVHCCLYFIP

SEQ ID NO: 4024 - protein, 15 aa, Artificial sequence
  Synthetic peptide
IPDTRVHCCLYFIPA

SEQ ID NO: 4025 - protein, 15 aa, Artificial sequence
  Synthetic peptide
PDTRVHCCLYFIPAT

SEQ ID NO: 4026 - protein, 15 aa, Artificial sequence
  Synthetic peptide
DTRVHCCLYFIPATG

SEQ ID NO: 4027 - protein, 15 aa, Artificial sequence
  Synthetic peptide
TRVHCCLYFIPATGH

SEQ ID NO: 4028 - protein, 15 aa, Artificial sequence
  Synthetic peptide
RVHCCLYFIPATGHS

SEQ ID NO: 4029 - protein, 15 aa, Artificial sequence
  Synthetic peptide
VHCCLYFIPATGHSL

SEQ ID NO: 4030 - protein, 15 aa, Artificial sequence
  Synthetic peptide
HCCLYFIPATGHSLR

SEQ ID NO: 4031 - protein, 15 aa, Artificial sequence
  Synthetic peptide
CCLYFIPATGHSLRP

SEQ ID NO: 4032 - protein, 15 aa, Artificial sequence
  Synthetic peptide
CLYFIPATGHSLRPL

SEQ ID NO: 4033 - protein, 15 aa, Artificial sequence
  Synthetic peptide
LYFIPATGHSLRPLD

SEQ ID NO: 4034 - protein, 15 aa, Artificial sequence
  Synthetic peptide
YFIPATGHSLRPLDI

SEQ ID NO: 4035 - protein, 15 aa, Artificial sequence
  Synthetic peptide
FIPATGHSLRPLDIE

SEQ ID NO: 4036 - protein, 15 aa, Artificial sequence
  Synthetic peptide
IPATGHSLRPLDIEF

SEQ ID NO: 4037 - protein, 15 aa, Artificial sequence
  Synthetic peptide
PATGHSLRPLDIEFM

SEQ ID NO: 4038 - protein, 15 aa, Artificial sequence
  Synthetic peptide
ATGHSLRPLDIEFMK

SEQ ID NO: 4039 - protein, 15 aa, Artificial sequence
  Synthetic peptide
TGHSLRPLDIEFMKR

SEQ ID NO: 4040 - protein, 15 aa, Artificial sequence
  Synthetic peptide
GHSLRPLDIEFMKRL

SEQ ID NO: 4041 - protein, 15 aa, Artificial sequence
  Synthetic peptide
HSLRPLDIEFMKRLS

SEQ ID NO: 4042 - protein, 15 aa, Artificial sequence
  Synthetic peptide
SLRPLDIEFMKRLSK

SEQ ID NO: 4043 - protein, 15 aa, Artificial sequence
  Synthetic peptide
LRPLDIEFMKRLSKV

SEQ ID NO: 4044 - protein, 15 aa, Artificial sequence
  Synthetic peptide
RPLDIEFMKRLSKVV

SEQ ID NO: 4045 - protein, 15 aa, Artificial sequence
  Synthetic peptide
PLDIEFMKRLSKVVN

SEQ ID NO: 4046 - protein, 15 aa, Artificial sequence
  Synthetic peptide
LDIEFMKRLSKVVNI

SEQ ID NO: 4047 - protein, 15 aa, Artificial sequence
  Synthetic peptide
DIEFMKRLSKVVNIV

SEQ ID NO: 4048 - protein, 15 aa, Artificial sequence
  Synthetic peptide
IEFMKRLSKVVNIVP

SEQ ID NO: 4049 - protein, 15 aa, Artificial sequence
  Synthetic peptide
EFMKRLSKVVNIVPV

SEQ ID NO: 4050 - protein, 15 aa, Artificial sequence
  Synthetic peptide
FMKRLSKVVNIVPVI

SEQ ID NO: 4051 - protein, 15 aa, Artificial sequence
  Synthetic peptide
MKRLSKVVNIVPVIA

SEQ ID NO: 4052 - protein, 15 aa, Artificial sequence
  Synthetic peptide
KRLSKVVNIVPVIAK

SEQ ID NO: 4053 - protein, 15 aa, Artificial sequence
  Synthetic peptide
RLSKVVNIVPVIAKA

SEQ ID NO: 4054 - protein, 15 aa, Artificial sequence
  Synthetic peptide
LSKVVNIVPVIAKAD

SEQ ID NO: 4055 - protein, 15 aa, Artificial sequence
  Synthetic peptide
SKVVNIVPVIAKADT

SEQ ID NO: 4056 - protein, 15 aa, Artificial sequence
  Synthetic peptide
KVVNIVPVIAKADTL

SEQ ID NO: 4057 - protein, 15 aa, Artificial sequence
  Synthetic peptide
VVNIVPVIAKADTLT

SEQ ID NO: 4058 - protein, 15 aa, Artificial sequence
  Synthetic peptide
VNIVPVIAKADTLTL

SEQ ID NO: 4059 - protein, 15 aa, Artificial sequence
  Synthetic peptide
NIVPVIAKADTLTLE

SEQ ID NO: 4060 - protein, 15 aa, Artificial sequence
  Synthetic peptide
IVPVIAKADTLTLEE

SEQ ID NO: 4061 - protein, 15 aa, Artificial sequence
  Synthetic peptide
VPVIAKADTLTLEER

SEQ ID NO: 4062 - protein, 15 aa, Artificial sequence
  Synthetic peptide
PVIAKADTLTLEERV

SEQ ID NO: 4063 - protein, 15 aa, Artificial sequence
  Synthetic peptide
VIAKADTLTLEERVH

SEQ ID NO: 4064 - protein, 15 aa, Artificial sequence
  Synthetic peptide
IAKADTLTLEERVHF

SEQ ID NO: 4065 - protein, 15 aa, Artificial sequence
  Synthetic peptide
AKADTLTLEERVHFK

SEQ ID NO: 4066 - protein, 15 aa, Artificial sequence
  Synthetic peptide
KADTLTLEERVHFKQ

SEQ ID NO: 4067 - protein, 15 aa, Artificial sequence
  Synthetic peptide
ADTLTLEERVHFKQR

SEQ ID NO: 4068 - protein, 15 aa, Artificial sequence
  Synthetic peptide
DTLTLEERVHFKQRI

SEQ ID NO: 4069 - protein, 15 aa, Artificial sequence
  Synthetic peptide
TLTLEERVHFKQRIT

SEQ ID NO: 4070 - protein, 15 aa, Artificial sequence
  Synthetic peptide
LTLEERVHFKQRITA

SEQ ID NO: 4071 - protein, 15 aa, Artificial sequence
  Synthetic peptide
TLEERVHFKQRITAD

SEQ ID NO: 4072 - protein, 15 aa, Artificial sequence
  Synthetic peptide
LEERVHFKQRITADL

SEQ ID NO: 4073 - protein, 15 aa, Artificial sequence
  Synthetic peptide
EERVHFKQRITADLL

SEQ ID NO: 4074 - protein, 15 aa, Artificial sequence
  Synthetic peptide
ERVHFKQRITADLLS

SEQ ID NO: 4075 - protein, 15 aa, Artificial sequence
  Synthetic peptide
RVHFKQRITADLLSN

SEQ ID NO: 4076 - protein, 15 aa, Artificial sequence
  Synthetic peptide
VHFKQRITADLLSNG

SEQ ID NO: 4077 - protein, 15 aa, Artificial sequence
  Synthetic peptide
HFKQRITADLLSNGI

SEQ ID NO: 4078 - protein, 15 aa, Artificial sequence
  Synthetic peptide
FKQRITADLLSNGID

SEQ ID NO: 4079 - protein, 15 aa, Artificial sequence
  Synthetic peptide
KQRITADLLSNGIDV

SEQ ID NO: 4080 - protein, 15 aa, Artificial sequence
  Synthetic peptide
QRITADLLSNGIDVY

SEQ ID NO: 4081 - protein, 15 aa, Artificial sequence
  Synthetic peptide
RITADLLSNGIDVYP

SEQ ID NO: 4082 - protein, 15 aa, Artificial sequence
  Synthetic peptide
ITADLLSNGIDVYPQ

SEQ ID NO: 4083 - protein, 15 aa, Artificial sequence
  Synthetic peptide
TADLLSNGIDVYPQK

SEQ ID NO: 4084 - protein, 15 aa, Artificial sequence
  Synthetic peptide
ADLLSNGIDVYPQKE

SEQ ID NO: 4085 - protein, 15 aa, Artificial sequence
  Synthetic peptide
DLLSNGIDVYPQKEF

SEQ ID NO: 4086 - protein, 15 aa, Artificial sequence
  Synthetic peptide
LLSNGIDVYPQKEFD

SEQ ID NO: 4087 - protein, 15 aa, Artificial sequence
  Synthetic peptide
LSNGIDVYPQKEFDE

SEQ ID NO: 4088 - protein, 15 aa, Artificial sequence
  Synthetic peptide
SNGIDVYPQKEFDED

SEQ ID NO: 4089 - protein, 15 aa, Artificial sequence
  Synthetic peptide
NGIDVYPQKEFDEDS

SEQ ID NO: 4090 - protein, 15 aa, Artificial sequence
  Synthetic peptide
GIDVYPQKEFDEDSE

SEQ ID NO: 4091 - protein, 15 aa, Artificial sequence
  Synthetic peptide
IDVYPQKEFDEDSED

SEQ ID NO: 4092 - protein, 15 aa, Artificial sequence
  Synthetic peptide
DVYPQKEFDEDSEDR

SEQ ID NO: 4093 - protein, 15 aa, Artificial sequence
  Synthetic peptide
VYPQKEFDEDSEDRL

SEQ ID NO: 4094 - protein, 15 aa, Artificial sequence
  Synthetic peptide
YPQKEFDEDSEDRLV

SEQ ID NO: 4095 - protein, 15 aa, Artificial sequence
  Synthetic peptide
PQKEFDEDSEDRLVN

SEQ ID NO: 4096 - protein, 15 aa, Artificial sequence
  Synthetic peptide
QKEFDEDSEDRLVNE

SEQ ID NO: 4097 - protein, 15 aa, Artificial sequence
  Synthetic peptide
KEFDEDSEDRLVNEK

SEQ ID NO: 4098 - protein, 15 aa, Artificial sequence
  Synthetic peptide
EFDEDSEDRLVNEKF

SEQ ID NO: 4099 - protein, 15 aa, Artificial sequence
  Synthetic peptide
FDEDSEDRLVNEKFR

SEQ ID NO: 4100 - protein, 15 aa, Artificial sequence
  Synthetic peptide
DEDSEDRLVNEKFRE

SEQ ID NO: 4101 - protein, 15 aa, Artificial sequence
  Synthetic peptide
EDSEDRLVNEKFREM

SEQ ID NO: 4102 - protein, 15 aa, Artificial sequence
  Synthetic peptide
DSEDRLVNEKFREMI

SEQ ID NO: 4103 - protein, 15 aa, Artificial sequence
  Synthetic peptide
SEDRLVNEKFREMIP

SEQ ID NO: 4104 - protein, 15 aa, Artificial sequence
  Synthetic peptide
EDRLVNEKFREMIPF

SEQ ID NO: 4105 - protein, 15 aa, Artificial sequence
  Synthetic peptide
DRLVNEKFREMIPFA

SEQ ID NO: 4106 - protein, 15 aa, Artificial sequence
  Synthetic peptide
RLVNEKFREMIPFAV

SEQ ID NO: 4107 - protein, 15 aa, Artificial sequence
  Synthetic peptide
LVNEKFREMIPFAVV

SEQ ID NO: 4108 - protein, 15 aa, Artificial sequence
  Synthetic peptide
VNEKFREMIPFAVVG

SEQ ID NO: 4109 - protein, 15 aa, Artificial sequence
  Synthetic peptide
NEKFREMIPFAVVGS

SEQ ID NO: 4110 - protein, 15 aa, Artificial sequence
  Synthetic peptide
EKFREMIPFAVVGSD

SEQ ID NO: 4111 - protein, 15 aa, Artificial sequence
  Synthetic peptide
KFREMIPFAVVGSDH

SEQ ID NO: 4112 - protein, 15 aa, Artificial sequence
  Synthetic peptide
FREMIPFAVVGSDHE

SEQ ID NO: 4113 - protein, 15 aa, Artificial sequence
  Synthetic peptide
REMIPFAVVGSDHEY

SEQ ID NO: 4114 - protein, 15 aa, Artificial sequence
  Synthetic peptide
EMIPFAVVGSDHEYQ

SEQ ID NO: 4115 - protein, 15 aa, Artificial sequence
  Synthetic peptide
MIPFAVVGSDHEYQV

SEQ ID NO: 4116 - protein, 15 aa, Artificial sequence
  Synthetic peptide
IPFAVVGSDHEYQVN

SEQ ID NO: 4117 - protein, 15 aa, Artificial sequence
  Synthetic peptide
PFAVVGSDHEYQVNG

SEQ ID NO: 4118 - protein, 15 aa, Artificial sequence
  Synthetic peptide
FAVVGSDHEYQVNGK

SEQ ID NO: 4119 - protein, 15 aa, Artificial sequence
  Synthetic peptide
AVVGSDHEYQVNGKR

SEQ ID NO: 4120 - protein, 15 aa, Artificial sequence
  Synthetic peptide
VVGSDHEYQVNGKRI

SEQ ID NO: 4121 - protein, 15 aa, Artificial sequence
  Synthetic peptide
VGSDHEYQVNGKRIL

SEQ ID NO: 4122 - protein, 15 aa, Artificial sequence
  Synthetic peptide
GSDHEYQVNGKRILG

SEQ ID NO: 4123 - protein, 15 aa, Artificial sequence
  Synthetic peptide
SDHEYQVNGKRILGR

SEQ ID NO: 4124 - protein, 15 aa, Artificial sequence
  Synthetic peptide
DHEYQVNGKRILGRK

SEQ ID NO: 4125 - protein, 15 aa, Artificial sequence
  Synthetic peptide
HEYQVNGKRILGRKT

SEQ ID NO: 4126 - protein, 15 aa, Artificial sequence
  Synthetic peptide
EYQVNGKRILGRKTK

SEQ ID NO: 4127 - protein, 15 aa, Artificial sequence
  Synthetic peptide
YQVNGKRILGRKTKW

SEQ ID NO: 4128 - protein, 15 aa, Artificial sequence
  Synthetic peptide
QVNGKRILGRKTKWG

SEQ ID NO: 4129 - protein, 15 aa, Artificial sequence
  Synthetic peptide
VNGKRILGRKTKWGT

SEQ ID NO: 4130 - protein, 15 aa, Artificial sequence
  Synthetic peptide
NGKRILGRKTKWGTI

SEQ ID NO: 4131 - protein, 15 aa, Artificial sequence
  Synthetic peptide
GKRILGRKTKWGTIE

SEQ ID NO: 4132 - protein, 15 aa, Artificial sequence
  Synthetic peptide
KRILGRKTKWGTIEV

SEQ ID NO: 4133 - protein, 15 aa, Artificial sequence
  Synthetic peptide
RILGRKTKWGTIEVE

SEQ ID NO: 4134 - protein, 15 aa, Artificial sequence
  Synthetic peptide
ILGRKTKWGTIEVEN

SEQ ID NO: 4135 - protein, 15 aa, Artificial sequence
  Synthetic peptide
LGRKTKWGTIEVENT

SEQ ID NO: 4136 - protein, 15 aa, Artificial sequence
  Synthetic peptide
GRKTKWGTIEVENTT

SEQ ID NO: 4137 - protein, 15 aa, Artificial sequence
  Synthetic peptide
RKTKWGTIEVENTTH

SEQ ID NO: 4138 - protein, 15 aa, Artificial sequence
  Synthetic peptide
KTKWGTIEVENTTHC

SEQ ID NO: 4139 - protein, 15 aa, Artificial sequence
  Synthetic peptide
TKWGTIEVENTTHCE

SEQ ID NO: 4140 - protein, 15 aa, Artificial sequence
  Synthetic peptide
KWGTIEVENTTHCEF

SEQ ID NO: 4141 - protein, 15 aa, Artificial sequence
  Synthetic peptide
WGTIEVENTTHCEFA

SEQ ID NO: 4142 - protein, 15 aa, Artificial sequence
  Synthetic peptide
GTIEVENTTHCEFAY

SEQ ID NO: 4143 - protein, 15 aa, Artificial sequence
  Synthetic peptide
TIEVENTTHCEFAYL

SEQ ID NO: 4144 - protein, 15 aa, Artificial sequence
  Synthetic peptide
IEVENTTHCEFAYLR

SEQ ID NO: 4145 - protein, 15 aa, Artificial sequence
  Synthetic peptide
EVENTTHCEFAYLRD

SEQ ID NO: 4146 - protein, 15 aa, Artificial sequence
  Synthetic peptide
VENTTHCEFAYLRDL

SEQ ID NO: 4147 - protein, 15 aa, Artificial sequence
  Synthetic peptide
ENTTHCEFAYLRDLL

SEQ ID NO: 4148 - protein, 15 aa, Artificial sequence
  Synthetic peptide
NTTHCEFAYLRDLLI

SEQ ID NO: 4149 - protein, 15 aa, Artificial sequence
  Synthetic peptide
TTHCEFAYLRDLLIR

SEQ ID NO: 4150 - protein, 15 aa, Artificial sequence
  Synthetic peptide
THCEFAYLRDLLIRT

SEQ ID NO: 4151 - protein, 15 aa, Artificial sequence
  Synthetic peptide
HCEFAYLRDLLIRTH

SEQ ID NO: 4152 - protein, 15 aa, Artificial sequence
  Synthetic peptide
CEFAYLRDLLIRTHM

SEQ ID NO: 4153 - protein, 15 aa, Artificial sequence
  Synthetic peptide
EFAYLRDLLIRTHMQ

SEQ ID NO: 4154 - protein, 15 aa, Artificial sequence
  Synthetic peptide
FAYLRDLLIRTHMQN

SEQ ID NO: 4155 - protein, 15 aa, Artificial sequence
  Synthetic peptide
AYLRDLLIRTHMQNI

SEQ ID NO: 4156 - protein, 15 aa, Artificial sequence
  Synthetic peptide
YLRDLLIRTHMQNIK

SEQ ID NO: 4157 - protein, 15 aa, Artificial sequence
  Synthetic peptide
LRDLLIRTHMQNIKD

SEQ ID NO: 4158 - protein, 15 aa, Artificial sequence
  Synthetic peptide
RDLLIRTHMQNIKDI

SEQ ID NO: 4159 - protein, 15 aa, Artificial sequence
  Synthetic peptide
DLLIRTHMQNIKDIT

SEQ ID NO: 4160 - protein, 15 aa, Artificial sequence
  Synthetic peptide
LLIRTHMQNIKDITS

SEQ ID NO: 4161 - protein, 15 aa, Artificial sequence
  Synthetic peptide
LIRTHMQNIKDITSS

SEQ ID NO: 4162 - protein, 15 aa, Artificial sequence
  Synthetic peptide
IRTHMQNIKDITSSI

SEQ ID NO: 4163 - protein, 15 aa, Artificial sequence
  Synthetic peptide
RTHMQNIKDITSSIH

SEQ ID NO: 4164 - protein, 15 aa, Artificial sequence
  Synthetic peptide
THMQNIKDITSSIHF

SEQ ID NO: 4165 - protein, 15 aa, Artificial sequence
  Synthetic peptide
HMQNIKDITSSIHFE

SEQ ID NO: 4166 - protein, 15 aa, Artificial sequence
  Synthetic peptide
MQNIKDITSSIHFEA

SEQ ID NO: 4167 - protein, 15 aa, Artificial sequence
  Synthetic peptide
QNIKDITSSIHFEAY

SEQ ID NO: 4168 - protein, 15 aa, Artificial sequence
  Synthetic peptide
NIKDITSSIHFEAYR

SEQ ID NO: 4169 - protein, 15 aa, Artificial sequence
  Synthetic peptide
IKDITSSIHFEAYRV

SEQ ID NO: 4170 - protein, 15 aa, Artificial sequence
  Synthetic peptide
KDITSSIHFEAYRVK

SEQ ID NO: 4171 - protein, 15 aa, Artificial sequence
  Synthetic peptide
DITSSIHFEAYRVKR

SEQ ID NO: 4172 - protein, 15 aa, Artificial sequence
  Synthetic peptide
ITSSIHFEAYRVKRL

SEQ ID NO: 4173 - protein, 15 aa, Artificial sequence
  Synthetic peptide
TSSIHFEAYRVKRLN

SEQ ID NO: 4174 - protein, 15 aa, Artificial sequence
  Synthetic peptide
SSIHFEAYRVKRLNE

SEQ ID NO: 4175 - protein, 15 aa, Artificial sequence
  Synthetic peptide
SIHFEAYRVKRLNEG

SEQ ID NO: 4176 - protein, 15 aa, Artificial sequence
  Synthetic peptide
IHFEAYRVKRLNEGS

SEQ ID NO: 4177 - protein, 15 aa, Artificial sequence
  Synthetic peptide
HFEAYRVKRLNEGSS

SEQ ID NO: 4178 - protein, 15 aa, Artificial sequence
  Synthetic peptide
FEAYRVKRLNEGSSA

SEQ ID NO: 4179 - protein, 15 aa, Artificial sequence
  Synthetic peptide
EAYRVKRLNEGSSAM

SEQ ID NO: 4180 - protein, 15 aa, Artificial sequence
  Synthetic peptide
AYRVKRLNEGSSAMA

SEQ ID NO: 4181 - protein, 15 aa, Artificial sequence
  Synthetic peptide
YRVKRLNEGSSAMAN

SEQ ID NO: 4182 - protein, 15 aa, Artificial sequence
  Synthetic peptide
RVKRLNEGSSAMANG

SEQ ID NO: 4183 - protein, 15 aa, Artificial sequence
  Synthetic peptide
VKRLNEGSSAMANGV

SEQ ID NO: 4184 - protein, 15 aa, Artificial sequence
  Synthetic peptide
KRLNEGSSAMANGVE

SEQ ID NO: 4185 - protein, 15 aa, Artificial sequence
  Synthetic peptide
RLNEGSSAMANGVEE

SEQ ID NO: 4186 - protein, 15 aa, Artificial sequence
  Synthetic peptide
LNEGSSAMANGVEEK

SEQ ID NO: 4187 - protein, 15 aa, Artificial sequence
  Synthetic peptide
NEGSSAMANGVEEKE

SEQ ID NO: 4188 - protein, 15 aa, Artificial sequence
  Synthetic peptide
EGSSAMANGVEEKEP

SEQ ID NO: 4189 - protein, 15 aa, Artificial sequence
  Synthetic peptide
GSSAMANGVEEKEPE

SEQ ID NO: 4190 - protein, 15 aa, Artificial sequence
  Synthetic peptide
SSAMANGVEEKEPEA

SEQ ID NO: 4191 - protein, 15 aa, Artificial sequence
  Synthetic peptide
SAMANGVEEKEPEAP

SEQ ID NO: 4192 - protein, 15 aa, Artificial sequence
  Synthetic peptide
AMANGVEEKEPEAPE

SEQ ID NO: 4193 - protein, 15 aa, Artificial sequence
  Synthetic peptide
MANGVEEKEPEAPEM

SEQ ID NO: 4194 - DNA, 21 bp, Artificial sequence
  SiRNA oligonucleotide
gccuccugaguaagacuuctt

SEQ ID NO: 4195 - DNA, 21 bp, Artificial sequence
  SiRNA oligonucleotide
cgugccuccugaguaagactt

SEQ ID NO: 4196 - DNA, 20 bp, Artificial sequence
  Antisense oligonucleotide
gctccctccaaccagactca

SEQ ID NO: 4197 - DNA, 20 bp, Artificial sequence
  Antisense oligonucleotide
gggttctttgcttctgtgtc

SEQ ID NO: 4198 - protein, 8 aa, Artificial sequence
  MSF-A GTP binding domain
GQSGLGKS

SEQ ID NO: 4199 - DNA, 56 bp, Artificial sequence
  Single strand DNA oligonucleotide
tggatttgaagagggtgttgattaaggtgaccaccatgatgttgaactcgaagccc

SEQ ID NO: 4200 - DNA, 20 bp, Artificial sequence
  Single strand DNA oligonucleotide
tcttcaagccatcctgtgtg

SEQ ID NO: 4201 - DNA, 20 bp, Artificial sequence
  Single strand DNA oligonucleotide
tctctcctatgtgctggcct

SEQ ID NO: 4202 - DNA, 20 bp, Artificial sequence
  Single strand DNA oligonucleotide
ggacaagtcaccacaggaca

SEQ ID NO: 4203 - DNA, 20 bp, Artificial sequence
  Single strand DNA oligonucleotide
gggagaaaatcaagtcgtgc

SEQ ID NO: 4204 - DNA, 20 bp, Artificial sequence
  Single strand DNA oligonucleotide
ctcctgagcgcaagtactcc

SEQ ID NO: 4205 - DNA, 21 bp, Artificial sequence
  Single strand DNA oligonucleotide
ctgcttgctgatccacatctg

SEQ ID NO: 4206 - DNA, 20 bp, Artificial sequence
  Single strand DNA oligonucleotide
ccatgagaaacagcgtcaaa

SEQ ID NO: 4207 - DNA, 20 bp, Artificial sequence
  Single strand DNA oligonucleotide
agtcaggaaccagcagagga

SEQ ID NO: 4208 - DNA, 20 bp, Artificial sequence
  Single strand DNA oligonucleotide
caaagaaggggatgaccaga

SEQ ID NO: 4209 - DNA, 20 bp, Artificial sequence
  Single strand DNA oligonucleotide
gaagtcagagggcaggagtg

SEQ ID NO: 4210 - DNA, 21 bp, Artificial sequence
  Single strand DNA oligonucleotide
gggcatgtgcttccagtatgt

SEQ ID NO: 4211 - DNA, 20 bp, Artificial sequence
  Single strand DNA oligonucleotide
accaggagcacagtgaagat

SEQ ID NO: 4212 - protein, 15 aa, Artificial sequence
  Synthetic peptide
KSYSGGTRTSSGRLR

SEQ ID NO: 4213 - protein, 25 aa, Artificial sequence
  Synthetic  peptide derived from the unique N-terminal sequence of MSF-A
MKKSYSGGTRTSSGRLRRLGDSSGP

SEQ ID NO: 4214 - DNA, 721 bp, Artificial sequence
  MSF-A cDNA
gccttcctactaccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttgg

SEQ ID NO: 4215 - protein, 578 aa, Artificial sequence
  MSF-A lacking the GTP binding domain
MKKSYSGGTRTSSGRLRRLGDSSGPALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGVEEKEPEAPEM

SEQ ID NO: 4216 - DNA, 56 bp, Artificial sequence
  Single strand DNA oligonucleotide
gggcttcgagttcaacatcatggtggtcaccttaatcaacaccctcttcaaatcca

What is claimed is:

1. A method of treating cancer and/or inhibiting a growth of a cancerous tumor and/or metastases in an individual comprising providing to the individual an siRNA which specifically hybridizes to a myeloid/lymphoid leukemia septin-like fusion protein A (MSF-A) polynucleotide (SEQ ID NO: 1), said MSF-A siRNA is capable of downregulating an MSF-A-dependent HIF-1α activity in cells of the individual thereby treating the cancer and/or inhibiting the growth of the cancerous tumor and/or the metastases in the individual.

2. The method of claim 1, wherein said cancer and/or said cancerous tumor is selected from the group consisting of prostate cancer, breast cancer, chemotherapy-induced MLL, stomach cancer, cervical cancer, endometrial cancer, and ovarian cancer.

3. A method of treating cancer and/or inhibiting a growth of a cancerous tumor and/or metastases in an individual comprising providing to the individual an MSF-A siRNA as set forth in SEQ ID NO: 4194, thereby treating the cancer and/or inhibiting the growth of the cancerous tumor and/or the metastases in the individual.

* * * * *